US012781225B2

(12) United States Patent
Bogorad et al.

(10) Patent No.: US 12,781,225 B2
(45) Date of Patent: Nov. 3, 2026

(54) OLIGONUCLEOTIDE-MEDIATED KNOCKDOWN OF DUX4

(71) Applicant: Soufflé Therapeutics, Inc., Watertown, MA (US)

(72) Inventors: Roman Bogorad, Newton, MA (US); Timofey Zatsepin, Brookline, MA (US); Vadim Dudkin, Wellesley, MA (US)

(73) Assignee: Soufflé Therapeutics, Inc., Watertown, MA (US)

( * ) Notice: Subject to any disclaimer, the term of this patent is extended or adjusted under 35 U.S.C. 154(b) by 0 days.

(21) Appl. No.: 19/410,976

(22) Filed: Dec. 5, 2025

(65) Prior Publication Data

US 2026/0159835 A1 Jun. 11, 2026

Related U.S. Application Data

(60) Provisional application No. 63/728,473, filed on Dec. 5, 2024.

(51) Int. Cl.
*C12N 15/113* (2010.01)

(52) U.S. Cl.
CPC ........ *C12N 15/113* (2013.01); *C12N 2310/14* (2013.01); *C12N 2310/315* (2013.01); *C12N 2310/321* (2013.01); *C12N 2310/322* (2013.01)

(58) Field of Classification Search
None
See application file for complete search history.

(56) References Cited

U.S. PATENT DOCUMENTS 5,138,045 A 8/1992 Cook et al.
5,212,295 A 5/1993 Cook
5,218,105 A 6/1993 Cook et al.
5,223,618 A 6/1993 Cook et al.
5,378,825 A 1/1995 Cook et al.
5,386,023 A 1/1995 Sanghvi et al.
5,457,191 A 10/1995 Cook et al.
5,459,255 A 10/1995 Cook et al.
5,506,351 A 4/1996 McGee
5,521,302 A 5/1996 Cook
5,539,082 A 7/1996 Nielsen et al.
5,541,307 A 7/1996 Cook et al.
5,554,746 A 9/1996 Ravikumar et al.
5,571,902 A 11/1996 Ravikumar et al.
5,578,718 A 11/1996 Cook et al.
5,587,361 A 12/1996 Cook et al.
5,587,469 A 12/1996 Cook et al.
5,587,470 A 12/1996 Cook et al.
5,599,797 A 2/1997 Cook et al.
5,602,240 A 2/1997 De Mesmaeker et al.
5,608,046 A 3/1997 Cook et al.
5,610,289 A 3/1997 Cook et al.
6,262,241 B1 7/2001 Cook et al.
9,988,628 B2 6/2018 Belayew et al.
10,385,338 B2 8/2019 Dumonceaux et al.
10,537,560 B2 1/2020 Cacace et al.
10,538,763 B2 1/2020 Rigo et al.
10,828,377 B2 11/2020 Mano et al.
10,907,157 B2 2/2021 Belayew et al.
11,332,733 B2 5/2022 Seth et al.
11,485,743 B2 11/2022 Mainolfi et al.
11,518,995 B2 12/2022 Chen et al.
11,525,137 B2 12/2022 Malecova et al.
11,555,190 B2 1/2023 Malecova et al.
11,674,140 B2 6/2023 Lek et al.
11,806,343 B2 11/2023 Rickard et al.
11,844,843 B2 12/2023 Subramanian et al.
11,898,143 B2 2/2024 Belayew et al.
11,912,779 B2 2/2024 Malecova et al.
11,963,975 B2 4/2024 Jones et al.
11,969,475 B2 4/2024 Subramanian et al.
11,999,955 B2 6/2024 Malecova et al.
12,049,629 B2 7/2024 Malecova et al.
12,071,485 B2 8/2024 Malecova et al.
12,084,658 B2 9/2024 Harper et al.
12,104,156 B2 10/2024 Malecova et al.
12,157,774 B2 12/2024 Malecova et al.
12,227,549 B2 2/2025 Fotin-Mleczek et al.
12,365,704 B2 7/2025 Doppalapudi et al.
12,383,534 B2 8/2025 Kyba et al.
12,428,487 B2 9/2025 Subramanian et al.
12,458,668 B2 11/2025 Tapscott et al.
12,478,657 B2 11/2025 Ko
12,486,328 B2 12/2025 Malecova et al.
12,497,615 B2 12/2025 Darimont et al.

(Continued)

FOREIGN PATENT DOCUMENTS

AU 2017258945 A1 1/2018
AU 2022201820 A1 4/2022

(Continued)

OTHER PUBLICATIONS

Kluchnikov et al. Molecular Therapy Nucleic Acids, vol. 36, pp. 1-14 (Year: 2025).*
Ahmad Dar et al. Scientific Reports 6:20031, pp. 1-8 (Year: 2016).*
He et al. Scientific Reports 7:44836, pp. 1-13 (Year: 2017).*
Abramova T., et al., "Novel oligonucleotide analogues based on morpholino nucleoside subunits-antisense technologies: new chemical possibilities," Indian journal of chemistry, vol. 48B, Organic including medicinal 48.12 (Dec 2009): 1721-1726.
Allen et al., "Targeting DUX4 mRNA with anti-TfR NANOBODY® oligonucleotide conjugates," [Poster P4.19, 2025 IRC Abstract Book] 32nd Annual FSHD Society International Research Congress, Amsterdam, Netherlands, (Jun. 12-13, 2025), 118 pages.
Anzalone, Vince, "2024 Summer Series of R&D WebinarsPart 1—Muscle Programs" [PowerPoint Presentation] Arrowhead Pharmaceuticals. [Accessed on May 23, 2024, publicly available at URL: https://ir.arrowheadpharma.com/events/event-details/2024-summer-series-rd-webinar-muscular-aro-dux4-and-aro-dm1], 58 pages.

(Continued)

*Primary Examiner* — Brian Whiteman
(74) *Attorney, Agent, or Firm* — COOLEY LLP; John Rearick; Gang Wang

(57) ABSTRACT

Provided herein are oligonucleotides for inhibiting the expression of Double Homeobox 4 (DUX4) and methods of using the oligonucleotides for reducing DUX4 expression in a subject.

30 Claims, No Drawings

Specification includes a Sequence Listing.

(56) References Cited

U.S. PATENT DOCUMENTS 12,529,056 B2 1/2026 Malecova et al.
12,624,396 B2 5/2026 Van Der Maarel et al.
2004/0265833 A1 12/2004 Lofton-Day et al.
2008/0064029 A1 3/2008 Lofton-Day et al.
2011/0159487 A1 6/2011 Hare et al.
2014/0242093 A1 8/2014 Tapscott et al.
2014/0296181 A1 10/2014 Arnold et al.
2015/0299807 A1 10/2015 Ross et al.
2015/0301067 A1 10/2015 Miller et al.
2016/0201132 A1 7/2016 Hayardeny et al.
2017/0009230 A1 1/2017 Agrawal et al.
2017/0306403 A1 10/2017 Jones et al.
2018/0045727 A1 2/2018 Spetzler et al.
2018/0050043 A1 2/2018 Sverdrup
2018/0237775 A1 8/2018 Dumonceaux et al.
2018/0245154 A1 8/2018 Tsalik et al.
2018/0256729 A1 9/2018 Seth et al.
2019/0105311 A1 4/2019 Cacace et al.
2019/0177794 A1 6/2019 Huang et al.
2019/0388547 A1 12/2019 Weeden et al.
2020/0087723 A1 3/2020 Halpern et al.
2020/0109402 A1 4/2020 Lee et al.
2020/0109406 A1 4/2020 Miller et al.
2020/0248179 A1 8/2020 Harper
2020/0261589 A1 8/2020 Galy et al.
2020/0297696 A1 9/2020 Sverdrup et al.
2020/0325237 A1 10/2020 Darimont et al.
2021/0010091 A1 1/2021 Kuiper et al.
2021/0017513 A1 1/2021 Seth et al.
2021/0052631 A1 2/2021 Prakash et al.
2021/0196723 A1 7/2021 Rickard et al.
2021/0198739 A1 7/2021 Van Der Maarel et al.
2021/0261680 A1 8/2021 Subramanian et al.
2021/0301290 A1* 9/2021 Malecova ............... A61P 21/00
2022/0049226 A1 2/2022 Schrepfer et al.
2022/0079951 A1 3/2022 Meyers et al.
2022/0098252 A1 3/2022 Gabellini et al.
2022/0106592 A1 4/2022 Harper et al.
2022/0117942 A1 4/2022 Attwell et al.
2022/0143221 A1 5/2022 Danos et al.
2022/0162672 A1 5/2022 Makarov et al.
2022/0202845 A1 6/2022 Bradley et al.
2022/0213505 A1 7/2022 Mingozzi et al.
2022/0226318 A1 7/2022 De Maeyer et al.
2022/0226340 A1 7/2022 De Maeyer et al.
2022/0228140 A1 7/2022 Kumagai et al.
2022/0241263 A1 8/2022 Alimzhanov et al.
2022/0267732 A1 8/2022 Cowan et al.
2022/0364086 A1 11/2022 Koizumi et al.
2022/0401539 A1 12/2022 Delattre et al.
2022/0411821 A1 12/2022 Wang et al.
2023/0025289 A1 1/2023 Schrepfer et al.
2023/0052017 A1 2/2023 Loke et al.
2023/0088865 A1 3/2023 Subramanian et al.
2023/0093080 A1 3/2023 Ji et al.
2023/0174958 A1 6/2023 Jones et al.
2023/0181621 A1 6/2023 Boletta et al.
2023/0193205 A1 6/2023 Ichim et al.
2023/0220473 A1 7/2023 Chen
2023/0250407 A1 8/2023 Jones et al.
2023/0257743 A1 8/2023 Cacace et al.
2023/0265430 A1 8/2023 Ding et al.
2023/0271953 A1 8/2023 Loke et al.
2023/0272065 A1 8/2023 Subramanian et al.
2023/0287420 A1 9/2023 Malecova et al.
2023/0293581 A1 9/2023 Schrepfer et al.
2023/0323456 A1 10/2023 Yamagata et al.
2023/0340469 A1 10/2023 Nelles
2023/0348906 A1 11/2023 Daugherty et al.
2023/0416737 A1 12/2023 Ding et al.
2024/0010988 A1 1/2024 Schrepfer et al.
2024/0018479 A1 1/2024 Emerson et al.
2024/0018594 A1 1/2024 Chen et al.
2024/0026356 A1 1/2024 Harper et al.
2024/0060140 A1 2/2024 Rosenzweig et al.
2024/0093191 A1 3/2024 Saad et al.
2024/0102083 A1 3/2024 Booth et al.
2024/0110184 A1 4/2024 Brown et al.
2024/0124600 A1 4/2024 Malecova et al.
2024/0132610 A1 4/2024 Malecova et al.
2024/0141346 A1 5/2024 Place et al.
2024/0141359 A1 5/2024 Emerson, Jr. et al.
2024/0181086 A1 6/2024 Quijano et al.
2024/0182561 A1 6/2024 Stitt et al.
2024/0192197 A1 6/2024 Jiang et al.
2024/0216482 A1 7/2024 Tsoa et al.
2024/0216530 A1 7/2024 Quijano et al.
2024/0247259 A1 7/2024 Shen et al.
2024/0252642 A1 8/2024 Schrepfer
2024/0254555 A1 8/2024 Keating et al.
2024/0271134 A1 8/2024 Saleh et al.
2024/0277776 A1 8/2024 Conway et al.
2024/0280590 A1 8/2024 Chamberlain et al.
2024/0285638 A1 8/2024 Harper et al.
2024/0317814 A1 9/2024 Richard et al.
2024/0318201 A1 9/2024 Harper et al.
2024/0327926 A1 10/2024 Otto et al.
2024/0336915 A1 10/2024 Valas et al.
2024/0352459 A1 10/2024 Emerson et al.
2024/0358761 A1 10/2024 Schrepfer
2024/0360455 A1 10/2024 Nair et al.
2024/0382605 A1 11/2024 Seth et al.
2024/0391969 A1 11/2024 Wang et al.
2024/0400707 A1 12/2024 Malecova et al.
2024/0401037 A1 12/2024 Belayew et al.
2024/0401061 A1* 12/2024 Kubli ........................ A61P 9/00
2024/0425820 A1 12/2024 Schrepfer
2025/0009904 A1 1/2025 Savva et al.
2025/0011775 A1 1/2025 Briggs et al.
2025/0019697 A1 1/2025 Harper
2025/0025569 A1 1/2025 Williams et al.
2025/0025570 A1 1/2025 Hsia et al.
2025/0051393 A1 2/2025 Qian et al.
2025/0051780 A1 2/2025 Qian et al.
2025/0084408 A1 3/2025 Byrne et al.
2025/0092376 A1 3/2025 Holm et al.
2025/0101382 A1 3/2025 Murry et al.
2025/0122529 A1 4/2025 Matias et al.
2025/0127820 A1 4/2025 Schrepfer
2025/0127912 A1 4/2025 Saleh et al.
2025/0129346 A1 4/2025 Dowdle et al.
2025/0163418 A1 5/2025 Zhang
2025/0177447 A1 6/2025 Kinder et al.
2025/0222039 A1 7/2025 Li et al.
2025/0223564 A1 7/2025 Schrepfer et al.
2025/0223598 A1 7/2025 Thompson
2025/0230470 A1 7/2025 Tham
2025/0249052 A1 8/2025 Fielden et al.
2025/0270340 A1 8/2025 Subramanian et al.
2025/0295814 A1 9/2025 Sper et al.
2025/0297251 A1 9/2025 Daugherty et al.
2025/0302876 A1 10/2025 Agarwal et al.
2025/0302953 A1 10/2025 Fry et al.
2025/0302979 A1 10/2025 Marks et al.
2025/0313555 A1 10/2025 Ozes et al.
2025/0313861 A1 10/2025 Fry et al.
2025/0333476 A1 10/2025 Johnson et al.
2025/0339531 A1 11/2025 Tapscott et al.
2025/0382582 A1 12/2025 Clarke et al.
2026/0009003 A1 1/2026 Sun et al.
2026/0034230 A1 2/2026 Zhang et al.

FOREIGN PATENT DOCUMENTS

CA 2528853 A1 6/2007
CN 113416785 A 9/2021
CN 113462763 A 10/2021
CN 114317753 A 4/2022
CN 113005200 B 7/2023
CN 116440286 A 7/2023
CN 116790758 A 9/2023
CN 117305457 A 12/2023
CN 117327789 A 1/2024
CN 117363720 A 1/2024

(56) References Cited

FOREIGN PATENT DOCUMENTS

| | | | | |
|---|---|---|---|---|
| CN | 117384853 A | | 1/2024 | |
| CN | 117672361 A | | 3/2024 | |
| CN | 114317741 B | | 7/2024 | |
| CN | 118702797 A | | 9/2024 | |
| CN | 118830516 A | | 10/2024 | |
| CN | 119351338 A | | 1/2025 | |
| CN | 115747336 B | | 9/2025 | |
| CN | 120591341 A | | 9/2025 | |
| CN | 120865375 A | | 10/2025 | |
| CN | 121065340 A | | 12/2025 | |
| CN | 117384852 B | | 1/2026 | |
| EP | 2426203 A2 | | 3/2012 | |
| JP | 2022055361 A | | 4/2022 | |
| RU | 2808833 | | 12/2023 | |
| WO | WO-2015143062 A1 | | 9/2015 | |
| WO | WO-2016115490 A1 | | 7/2016 | |
| WO | WO-2017054086 A1 | | 4/2017 | |
| WO | WO-2017065000 A1 | | 4/2017 | |
| WO | WO-2018073787 A3 | | 6/2018 | |
| WO | WO-2021037978 A1 | | 3/2021 | |
| WO | WO-2021188390 A1 | | 9/2021 | |
| WO | WO-2022051332 A1 | | 3/2022 | |
| WO | WO-2022147207 A1 | | 7/2022 | |
| WO | WO-2023283629 A1 | | 1/2023 | |
| WO | WO-2023288289 A2 | * | 1/2023 | ........... C12N 15/113 |
| WO | WO-2023019203 A1 | | 2/2023 | |
| WO | WO-2023036874 A1 | | 3/2023 | |
| WO | WO-2023056388 A1 | | 4/2023 | |
| WO | WO-2023168202 A2 | | 9/2023 | |
| WO | WO-2023183313 A1 | | 9/2023 | |
| WO | WO-2023185946 A1 | | 10/2023 | |
| WO | WO-2024011135 A2 | | 1/2024 | |
| WO | WO-2024012420 A1 | | 1/2024 | |
| WO | WO-2024044282 A1 | | 2/2024 | |
| WO | WO-2024081411 A1 | | 4/2024 | |
| WO | WO-2024086633 A1 | | 4/2024 | |
| WO | WO-2024102965 A1 | | 5/2024 | |
| WO | WO-2024112809 A2 | | 5/2024 | |
| WO | WO-2024124088 A1 | | 6/2024 | |
| WO | WO-2024125592 A1 | | 6/2024 | |
| WO | WO-2024129931 A1 | | 6/2024 | |
| WO | WO-2024149282 A1 | | 7/2024 | |
| WO | WO-2024151737 A2 | | 7/2024 | |
| WO | WO-2024163952 A3 | | 9/2024 | |
| WO | WO-2024192263 A2 | | 9/2024 | |
| WO | WO-2024204724 A1 | | 10/2024 | |
| WO | WO-2024229302 A1 | | 11/2024 | |
| WO | WO-2024238584 A1 | | 11/2024 | |
| WO | WO-2024220947 A3 | | 12/2024 | |
| WO | WO-2024229211 A3 | | 12/2024 | |
| WO | WO-2024255846 A1 | | 12/2024 | |
| WO | WO-2024220598 A9 | | 1/2025 | |
| WO | WO-2024226860 A3 | | 1/2025 | |
| WO | WO-2024243236 A3 | | 1/2025 | |
| WO | WO-2025019732 A1 | | 1/2025 | |
| WO | WO-2025019820 A1 | | 1/2025 | |
| WO | WO-2025021034 A1 | | 1/2025 | |
| WO | WO-2025026925 A1 | | 2/2025 | |
| WO | WO-2025054202 A1 | | 3/2025 | |
| WO | WO-2025061158 A1 | | 3/2025 | |
| WO | WO-2025081023 A1 | | 4/2025 | |
| WO | WO-2025085878 A1 | | 4/2025 | |
| WO | WO-2025101068 A1 | | 5/2025 | |
| WO | WO-2025108237 A1 | | 5/2025 | |
| WO | WO-2025137547 A8 | | 7/2025 | |
| WO | WO-2025137637 A3 | | 7/2025 | |
| WO | WO-2025140565 A1 | | 7/2025 | |
| WO | WO-2025160275 A1 | | 7/2025 | |
| WO | WO-2025212838 A1 | | 10/2025 | |
| WO | WO-2025212961 A1 | | 10/2025 | |
| WO | WO-2025230941 A1 | | 11/2025 | |
| WO | WO-2025230947 A1 | | 11/2025 | |
| WO | WO-2025235563 A1 | | 11/2025 | |
| WO | WO-2025250883 A1 | | 12/2025 | |
| WO | WO-2025252100 A1 | | 12/2025 | |
| WO | WO-2025255283 A1 | | 12/2025 | |
| WO | WO-2025257347 A1 | | 12/2025 | |
| WO | WO-2025259503 A1 | | 12/2025 | |
| WO | WO-2025259607 A1 | | 12/2025 | |
| WO | WO-2025259743 A1 | | 12/2025 | |
| WO | WO-2025260007 A1 | | 12/2025 | |
| WO | WO-2026006334 A1 | | 1/2026 | |
| WO | WO-2026026811 A1 | | 2/2026 | |
| WO | WO-2026030242 A1 | | 2/2026 | |
| WO | WO-2026122993 A2 | | 6/2026 | |

OTHER PUBLICATIONS

Avidity Biosciences, "Transforming Facioscapulohumeral Muscular Dystrophy (FSHD) AOC 1020 FORTITUDETM Phase 1/2 Initial Data," [PowerPoint slides]. Investorroom. [Accessed on Jun. 12, 2024, publicly available at URL: https://filecache.investorroom.com/mr5ir_aviditybiosciences/228/download/FINAL%20Avidity%20FSHD%20AOC%201020%20Data%20Webcast%20Deck%206.12.24.pdf], 47 pages.

Avidity Biosciences, "Delivering for People Living with Facioscapulohumeral Muscular Dystrophy (FSHD)," [PowerPoint slides]. Investorroom. [Accessed on Jun. 9, 2025, publicly available at URL: https://filecache.investorroom.com/mr5ir_aviditybiosciences/262/06-09-25%20Del-brax%20Topline%20Webcast%20Deck%20for%20website.pdf], 38 pages.

Bakewell, J., et al., "DUX4-rearranged B-ALL: deciphering a biological and clinical conundrum: Acute Lymphoblastic Leukemia," Epub Sep. 12, 2025; published Dec 2025; 39(12):2835-2847.

Beaucage, S. L., "Oligodeoxyribonucleotides synthesis: Phosphoramidite approach," Methods Mol Biol., 1993:20:33-61.

Beigelman L., et al. "Chemical Modification of Hammerhead Ribozymes: Catalytic Activity and Nuclease Resistance (*)," Journal of biological chemistry 270.43, Oct. 1995, 25702-25708.

Berge et al., "Pharmaceutical salts," J Pharm Sci. Jan. 1977; 6(1):1-19.

Bouwman et al. "The prospects of targeting DUX4 in facioscapulohumeral muscular dystrophy," Current Opinion in Neurology, Oct. 2020, 33(5):635-640.

Bouwman et al. "Systemic delivery of a DUX4-targeting antisense oligonucleotide to treat facioscapulohumeral muscular dystrophy," Molecular Therapy Nucleic Acids, Sep. 27, 2021; 26:813-27. eCollection Dec 3, 2021.

Campbell., et al., "BET bromodomain inhibitors and agonists of the beta-2 adrenergic receptor identified in screens for compounds that inhibit DUX4 expression in FSHD muscle cells," Skelet Muscle, Sep. 4, 2017;7(1):16.

Chau et al., "Relationship of DUX4 and target gene expression in FSHD myocytes," Hum Mutat., Apr. 2021; 42(4): 421-433.

Chen L., et al., "Single-cell spatial transcriptomics reveals a dystrophic trajectory following a developmental bifurcation of myoblast cell fates in facioscapulohumeral muscular dystrophy," Genome Res, Jun. 25, 2024; 34(5):665-679.

Clinical Trial Protocol No. ARODUX4-1001, "A Phase 1/2a Dose-Escalating Study to Evaluate the Safety, Tolerability, Pharmacokinetics, and Pharmacodynamics of ARO-DUX4 in Adult Patients with Facioscapulohumeral Muscular Dystrophy Type 1," [clinical trial protocol], amendment 4, Clinical trials in the European Union—EMA. "ARO-DUX4 for injection protocol No. ARODUX4-1001 protocol synopsis," (posted date Aug. 19, 2024) [Retrieval date unknown, publicly available at URL: https://euclinicaltrials.eu/ctis-public/view/2023-509748-89-00?lang=en.], 11 pages.

Earnshaw D.J., et al.,"Modified oligoribonucleotides as site-specific probes of RNA structure and function," Biopolymers: Original Research on Biomolecules 48.1, Aug. 18, 1998, vol. 48, pp. 39-55.

Fox., et al., "SIX transcription factors are necessary for the activation of DUX4 expression in facioscapulohumeral muscular dystrophy," Skelet Muscle, Dec 3, 2024;14(1):30, 18 pages.

Gait., et al., "Applications of Chemically synthesized RNA in RNA: Protein Interactions," Ed. Smith (1998), 1-36.

Gall., et al. "Therapeutic Strategies Targeting DUX4 in FSHD," Journal of Clinical Medicine. (Sep. 7, 2020);9(9):2886, 20 pages.

(56) References Cited

OTHER PUBLICATIONS

Gallo., et al., “2’-C-Methyluridine phosphoramidite: a new building block for the preparation of RNA analogues carrying the 2’-hydroxyl group,” Tetrahedron, May 2001. 57, 5707-5713.
Gao M., et al., “Human-specific activation of the DUX4-SLC34A2 axis by herpesviruses suppresses antiviral innate immunity,” mBio. Dec 10, 2025;16(12):e0255425, 17 pages.
Geng L., “Double homeobox 4 activates germline genes, endogenous retroelements and immune modulators: Implications for facioscapulohumeral muscular dystrophy,” [dissertation] Doctor of Philosophy, University of Washington, 2011, [Retrieval date unknown, publicly available at URL: https://digital.lib.washington.edu/researchworks/items/9392f6d8-374e-4ed0-8564-cbf14e420c75.], 188 pages.
Geng L.N., et al., “DUX4 activates germline genes, retroelements, and immune mediators: implications for facioscapulohumeral dystrophy,” Dev Cell. Jan. 17, 2012;22(1):38-51.
Griffey R.H., et al., “2’-O-aminopropyl ribonucleotides: a zwitterionic modification that enhances the exonuclease resistance and biological activity of antisense oligonucleotides,” Journal of medicinal chemistry, Dec 20, 1996;39(26):5100-9.
Gros M., et al., “Identification of Serum Interleukin 6 Levels as a Disease Severity Biomarker in Facioscapulohumeral Muscular Dystrophy,” Journal of Neuromuscular Diseases. 2022;9(1):83-93.
Hayakawa Y, et al., “Facile synthesis of oligodeoxyribonucleotides via the phosphoramidite method without nucleoside base protection,” J Am Chem Soc, Jun. 1998;120:12395-401.
Himeda et al., “FSHD Therapeutic Strategies: What Will It Take to Get to Clinic?” Journal of Personalized Medicine (May 25, 2022), 12, 865, 19 pages.
Jacobs J. W., “Losmapimod, a p38α/β MAPK Inhibitor for the Potential Treatment of Patients with FSHD,” [PowerPoint Presentation] Fulcrum Therapeutics (Jun. 23, 2024) [Retrieval date Jun. 23, 2024, publicly available at URL: https://www.fulcrumtx.com/wp-content/uploads/JJacobs-Losmapimod-and-FSHD-New-Directions-2024-06-23-Final.pdf], 26 pages.
Statland, Jeffrey, “Topline Results from FORTITUDETM, a Randomized Phase 1/2 Trial Evaluating AOC 1020 (Del-brax) in Adults with FSHD” Topline Results from FORTITUDETM, a Randomized Phase 1/2 Trial Evaluating AOC 1020 (Del-brax) in Adults with FSHDTopline Results from FORTITUDETM, a Randomized Phase 1/2 Trial Evaluating AOC 1020 (Del-brax) in Adults with FSHD, [PowerPoint slides]. Avidity Biosciences. (Jun. 12-13, 2017), [Retrieval date Jun. 20, 2025, publicly available at URL: https://www.aviditybiosciences.com/sites/default/files/2025-06/IRC%20Jun%202025_FORTITUDE%20FINAL.pdf], 23 pages.
Karpeisky A., et al., “Highly efficient synthesis of 2’-O-amino nucleosides and their incorporation in hammerhead ribozymes,” Tetrahedron letters 39.10, Mar. 1998, 1131-1134.
Koizumi M., 2’-O,4’-C-ethylene-bridged nucleic acids (ENA) as next-generation antisense and antigene agents, Biological and Pharmaceutical Bulletin, Apr. 2004;27(4):453-6.
Kong., et al., “Engineered FSHD mutations results in D4Z4 heterochromatin disruption and feedforward DUX4 network activation,” iScience, Feb. 29, 2024;27(4):109357, 26 pages.
Kools J., “Facioscapulohumeral muscular dystrophy (FSHD) disease progression and losmapimod efficacy assessed by reachable workspace in both arms,” [Powerpoint Presentation] Fulcrum Therapeutics, (Jun. 14, 2024) [Retrieval date unknown, publicly available at URL: https://www.fulcrumtx.com/wp-content/uploads/Facioscapulohumeral-Muscular-Dystrophy-FSHD-Disease-Progression-by-RWS-average-of-the-two-arms-for-FSHD-IRC-May-23_final-post-MLR-002.pdf], 18 pages.
Lemmers R.J., et al., “A unifying genetic model for facioscapulohumeral muscular dystrophy,” Science, Sep. 24, 2010;329(5999):1650-3.
Lim., et al., “Genetic Approaches for the Treatment of Facioscapulohumeral Muscular Dystrophy,” Front Pharmacol. Mar. 12, 2021;12:642858, 13 pages.
Loakes D.,“Survey and summary: The applications of universal DNA base analogues,” Nucleic Acids Research, Jun. 15, 2001;29(12):2437-47.
Malecova B., et al., “Targeted tissue delivery of RNA therapeutics using antibody-oligonucleotide conjugates (AOCs),” Nucleic acids research, Jul. 7, 2023;51(12):5901-5910.
Malecova., et al., “AOC 1020: An Antibody Oligonucleotide Conjugate (AOC) in Development for the Treatment of FSHD,” [Poster], Poster No. WMS LSVP.08, 27th International Hybrid Annual Congress of the World Muscle Society, Avidity Biosciences, Inc (2022) [Retrieval date unknown, publicly available at https://www.aviditybiosciences.com/sites/default/files/2025-04/63086_Avidity_BM-FSHD-AOC-1020-WMS_Poster-36x42in-05FB_FINAL-LSVP.08.pdf], 1 page.
Malecova., et al., “DUX4 siRNA Optimization for the Development of an Antibody-Oligonucleotide Conjugate (AOCTM) for the Treatment of FSHD,” [Poster Session]. Muscular Dystrophy Association (MDA) Clinical & Scientific Conference, Nashville, Tennessee, United States, Avidity Biosciences, Inc (2022), 3 pages.
Martinez J., et al., “Single-stranded antisense siRNAs guide target RNA cleavage in RNAi,” Cell, Sep. 6, 2002;110(5):563-74.
Mocciaro E., et al., “DUX4 Role in Normal Physiology and in FSHD Muscular Dystrophy,” Cells, Nov. 26, 2021;10(12):3322, 25 pages.
Mocciaro., et al., “WDR5 is required for DUX4 expression and its pathological effects in FSHD muscular dystrophy,” Nucleic Acids Research, Jun. 9, 2023;51(10):5144-5161.
Picariello et al., “The FORCE Platform Achieves Robust and Durable DUX4 Suppression and Improves Muscle Function in a Facioscapulohumeral Muscular Dystrophy Mouse Model,” (Oct. 12, 2024), [Retrieval date unknown, publicly available at URL: https://www.dyne-tx.com/wp-content/uploads/Picariello_FSHD_WMS_2024.pdf], 1 page.
Pineda JMB., et al., “DUX4 is a common driver of immune evasion and immunotherapy failure in metastatic cancers,” Elife, Jun. 3, 2024;12:RP89017, 26 pages.
Ponce R.K.M., “Molecular and therapeutic advancements in Capicua (CIC)-rearranged sarcoma,” Frontiers in Cell and Developmental Biology, May 31, 2024;12:1416697, 11 pages.
Ronco L., et al., “A Biomarker of Aberrant DUX4 Activity to Evaluate Losmapimod Treatment Effect in FSHD Phase 2 Trials,” [Poster], Poster No. P.231, (Oct. 1, 2020), [Retrieval date unknown, publicly available at URL: https://www.fulcrumtx.com/wp-content/uploads/A-Biomarker-of-Aberrant-DUX4-Activity-to-Evaluate-Losmapimod-Treatment-Effect-in-FSHD-Phase-2-Trials.pdf], 1 page.
Roy S., et al., “Synthesis of DNA/RNA and their analogs via phosphoramidite and H-phosphonate chemistries,” Molecules, Nov. 18, 2013;18(11):14268-84.
Scaringe S.A., “RNA oligonucleotide synthesis via 5’-silyl-2’-orthoester chemistry,” Methods, Mar. 2001;23(3):206-17.
Schwarz D.S., et al., “Evidence that siRNAs function as guides, not primers, in the *Drosophila* and human RNAi pathways,” Molecular cell, Sep. 2002;10(3):537-48.
Shao Y., et al., “Rational design and rapid screening of antisense oligonucleotides for prokaryotic gene modulation,” Nucleic acids research, Oct. 2006;34(19):5660-9.
Smith, A. A., “DUX4 expression in development versus disease: DUX4 expression in spermatogenesis, placentation, cancer and FSHD,” (Feb. 12, 2024), [Retrieval date unknown, publicly available at URL: https://digital.lib.washington.edu/researchworks/items/793d3d01-6880-4182-a053-e40ded135892], 66 pages.
Statland., et al., “Interim Results from FORTITUDE TM, a Randomized Phase 1/2 Trial Evaluating AOC 1020 in Adults with FSHD,” [Poster], Neuromuscular Study Group Annual Scientific Meeting, Avidity Biosciences, Inc, (2024), [Retrieval date unknown, publicly available at URL: https://www.aviditybiosciences.com/sites/default/files/2025-04/Final-NMSG-2024-FORTITUDE-Poster-16SEP24.pdf.],1 page.
Summerton J.E., “Morpholino, siRNA, and S-DNA compared: impact of structure and mechanism of action on off-target effects and sequence specificity,” Current topics in medicinal chemistry. 2007;7(7):651-60.

(56) References Cited

OTHER PUBLICATIONS

Sutliff, et al., "Characterization of a promising DUX4-Regulated Circulating biomarker for FSHD," [Poster] International Research Conference, (Jun. 13, 2025), [Retrieval date Jun. 2025, publicly available at URL: https://www.aviditybiosciences.com/sites/default/files/2025-06/TapscottFSHDIRC2025%20Poste%20Final.pdf], 1 page.
Sutliff N.A., et al., "Identification of KHDC1L, a DUX4-regulated protein, as a novel plasma biomarker in facioscapulohumeral muscular dystrophy," Hum Mol Genet, Feb. 9, 2026;35(2): ddaf183, 9 pages.
Tawil R., et al., "Facioscapulohumeral muscular dystrophy. Muscle & Nerve: Official Journal of the American Association of Electrodiagnostic Medicine," Jul. 2006;34(1):1-15.
Tihaya M.S., et al., "Facioscapulohumeral muscular dystrophy: the road to targeted therapies," Nature Review Neurology, Feb. 2023;19(2):91-108.
Usman N., et al., Exploiting the chemical synthesis of RNA. Trends in biochemical sciences. Sep. 1992;17(9):334-9.
Van Den Heuvel, et al., "Single-cell RNA sequencing in facioscapulohumeral muscular dystrophy disease etiology and development," Human molecular genetics. Apr. 1, 2019;28(7):1064-1075.
Van Dyke., et al., "Development of an RNAi Therapeutic, ARO DUX4, for the Treatment of FSHD" [Powerpoint Presentation] arrowhead pharmaceuticals, 28th Annual FSHD Society International Research Congress, Amsterdam, Netherlands, (Jun. 25, 2021), 11 pages.
Vangipurapu R. et al., GENBANK, Accession No. NM_001306068.3, "*Homo sapiens* double homeobox 4 (DUX4), MRNA," (Record created Nov. 12, 2019), [Retrieval date Feb. 11, 2026, publicly available at URL: https://www.ncbi.nlm.nih.gov/nuccore/NM_001306068.3.], 4 pages.
Verma et al., "Modified Oligonucleotides: Synthesis and Strategy for Users," Annual Review of Biochemistry, Jul. 1998, 67(1), pp. 99-134.
Wallace., et al., "Targeting DUX4 mRNA with anti-TfR NANOBODY® antisense oligonucleotide conjugates," [Poster] 21st Annual Meeting of the Oligonucleotide Therapeutics Society (OTS), Budapest, Hungary, Mirecule RNA Therapeutics, (Oct. 19-22, 2025), 1 page.
Wang., et al., "Current Therapeutic Approaches in FSHD," J Neuromuscul Dis. 2021;8(3):441-451.
Yoshida T., et al., "Evaluation of off-target effects of gapmer antisense oligonucleotides using human cells," Genes Cells. Dec 2019;24(12):827-835.
Zanotti S., "DYNE-302 Leads to Functional Improvement and Resolves Muscle Transcriptomic Changes in Mouse Models of FSHD," [Powerpoint Presentation], FSHD International Research Conference, 2025, Dyne Therapeutics, (Jun. 13, 2025), [Retrieval date Jun. 2025, publicly available at URL: http://www.dyne-tx.com/wp-content/uploads/Zanotti_FSHD-IRC_June_2025.pdf], 17 pages.
Zhang A., et al., "DUX4 reduction and muscle function improvement by subcutaneous delivery of gapmer antisense oligonucleotides," Molecular therapy. Nucleic acids. Dec 8, 2025;37(1):102791, 24 pages.
Genbank, Accession No. FJ439133.1 "*Homo sapiens* clone lambda42 DUX4 (DUX4) genes, complete cds," [sequence database entry], National Center for Biotechnology Information (NCBI), submitted Apr. 23, 2009. [Accessed Apr. 27, 2026, publicly available at URL: https://www.ncbi.nlm.nih.gov/nuccore/FJ439133], 5 pages.
PCT Application No. PCT/US2025/058469, International Search Report and Written Opinion mailed Jun. 3, 2026, Applicant Soufflé Therapeutics, Inc et al.; 23 pages.

* cited by examiner

OLIGONUCLEOTIDE-MEDIATED KNOCKDOWN OF DUX4

CROSS REFERENCE TO RELATED APPLICATIONS

This application claims the benefit of U.S. Provisional Application No. 63/728,473 filed on Dec. 5, 2024, the entirety of which is incorporated herein by reference.

INCORPORATION BY REFERENCE OF SEQUENCE LISTING

The present application is being filed along with a Sequence Listing in electronic format. The Sequence Listing is provided as a file entitled 360770-0003_SeqList_ST26.xml, created Dec. 4, 2025, which is 19,950,082 bytes in size. The information in the electronic format of the Sequence Listing is incorporated herein by reference in its entirety.

BACKGROUND

Facioscapulohumeral muscular dystrophy (FSHD) is a genetic disease affecting approximately 1 in 8,000 to 22,000 individuals worldwide, making it one of the most prevalent forms of muscular dystrophy. This autosomal dominant myopathy is characterized by progressive muscle weakness and atrophy, primarily impacting muscles in the face, shoulder girdle, and upper arms. As the condition progresses, additional muscle groups can be affected, such as the ankle dorsiflexors and proximal leg muscles, potentially leading to wheelchair dependence for around 20% of patients. Beyond muscular weakness, FSHD can also manifest with extra-muscular symptoms, including hearing loss, retinal vasculopathy, and cardiac conduction defects. FSHD has two distinct types: FSHD1 and FSHD2. The root cause in both types is the de-repression of a specific genetic region known as the D4Z4 macrosatellite repeat array, located on chromosome 4: FSHD1 (95% of cases)—a contraction of the D4Z4 repeat array to less than 10 units; FSHD2 (5% of cases)—mutations in genes involved in regulating the D4Z4 array. Despite the different genetic mechanisms, both FSHD1 and FSHD2 result in a loss of methylation in the D4Z4 region, leading to the same clinical presentation. The de-repression of the D4Z4 array leads to the aberrant expression of the DUX4 gene in skeletal muscle. This gene encodes a transcription factor normally active during early embryonic development but silenced in adult tissues, except for specific isoforms in the testis and thymus. The increased expression of DUX4 in adult muscle is highly toxic, causing a cascade of cellular problems that contribute to muscle degeneration: oxidative stress, dysregulated transcript quality control, protein aggregation, inflammation, impaired myogenesis, and muscle atrophy.

Due to the critical role of DUX4 in FSHD pathogenesis, it has become the primary target for therapeutic development. Various oligonucleotide therapies targeting DUX4 have shown promising results in preclinical studies. While significant progress has been made in understanding FSHD, further research is necessary to fully comprehend its complex nature and address the remaining unanswered questions. Overall, there is an unmet medical need for patients with FSHD that can be addressed by siRNA therapeutics.

SUMMARY

In some embodiments, the present disclosure provides an oligonucleotide for inhibiting expression of DUX4, wherein the oligonucleotide comprises an antisense strand comprising at least 14 contiguous nucleotides substantially complementary to a sequence of nucleotides encoding DUX4, with no more than 4 mismatched nucleotides.

In some embodiments, the present disclosure provides a pharmaceutical composition comprising an oligonucleotide described herein, or a pharmaceutically acceptable salt thereof, and a pharmaceutically acceptable carrier or excipient.

In some embodiments, the present disclosure provides methods of using provided oligonucleotides. In some embodiments, the present disclosure provides a method for inhibiting DUX4 expression or treating a DUX4 related disorder in a subject, the method comprising administering an effective amount of an oligonucleotide described herein, or a pharmaceutically acceptable salt thereof, or a pharmaceutical composition comprising an oligonucleotide described herein to the subject.

DETAILED DESCRIPTION

Provided herein are oligonucleotides for inhibiting the expression of Double Homeobox 4 ("DUX4"). In some embodiments, the oligonucleotide comprises an antisense strand substantially complementary to a sequence encoding DUX4. In some embodiments, the antisense strand comprises at least 14 contiguous nucleotides (for example, 14, 15, 16, 17, 18, 19, 20, 21, 22, 23, 24, 25, 26, 27, 28, 29, 30, 31, 32, 33, 34, 35, 36, 37, 38, 39, or 40 contiguous nucleotides) substantially complementary to the sequence of nucleotides encoding DUX4, with no more than 4 mismatched nucleotides.

The term "antisense strand" refers to an oligonucleotide having a nucleotide sequence substantially complementary to a target sequence in a transcript, e.g., an mRNA encoding DUX4. In embodiments wherein the oligonucleotide is an RNAi agent, the term antisense strand may be used interchangeably with the term "guide strand". In some embodiments, an antisense strand disclosed herein is 14, 15, 16, 17, 18, 19, 20, 21, 22, 23, 24, 25, 26, 27, 28, 29, or 30 nucleotides in length.

The term "sense strand" refers to an oligonucleotide having a nucleotide sequence substantially complementary to an antisense strand, e.g., the antisense strand of an RNAi agent herein. The term "sense strand" may be used interchangeably with the term "passenger strand." In some embodiments, a sense strand disclosed herein is 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides in length. For example, each of the sense strands in Tables 1A-1F is 19 nucleotides in length and substantially complementary to the corresponding antisense strand shown in the same row.

As used herein, and unless otherwise indicated, the term "complementary," when used to describe a first nucleotide sequence in relation to a second nucleotide sequence, refers to the ability of an oligonucleotide comprising the first nucleotide sequence to hybridize and form a duplex structure under certain conditions with an oligonucleotide comprising the second nucleotide sequence, as will be understood by the skilled person. In some embodiments, a duplex structure disclosed herein is 12, 13, 14, 15, 16, 17, 18, 19, 20, 21, 22, 23, 24, 25, 26, 27, 28, 29, or 30 base pairs in length.

The terms "complementary," "completely complementary" and "substantially complementary" herein can be used with respect to the base matching between the antisense strand of an oligonucleotide, e.g., an RNAi agent, and a target sequence, or between the sense strand and the antisense strand of an RNAi agent, as will be understood from the context of their use. Complementary sequences, e.g., between an antisense strand and a target sequence in a target transcript, or between the sense and antisense strand of an siRNA, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "completely complementary" with respect to each other when there are 0 mismatched base pairs upon hybridization of the two sequences. However, where a first sequence is referred to as "substantially complementary" with respect to a second sequence herein, the two sequences can be completely complementary, or they can form one or more, but generally not more than 5, 4, 3, 2, or 1 mismatched base pairs upon hybridization for a duplex up to 30 base pairs, while retaining the ability to hybridize under the conditions most relevant to their ultimate application, e.g., inhibition of gene expression via a RNA-induced silencing complex (RISC) pathway. However, where two oligonucleotides are designed to form, upon hybridization, one or more single stranded overhangs, such overhangs shall not be regarded as mismatches with regard to the determination of complementarity. For example, an siRNA comprising one oligonucleotide 21 nucleotides in length and another oligonucleotide 19 nucleotides in length, wherein the longer oligonucleotide comprises a sequence of 19 nucleotides that is fully complementary to the shorter oligonucleotide, can yet be referred to as "completely complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

If an RNA strand contains one or more thymidines ("T"s) in the sequence, the thymidines ("T"s) represent uridines ("U"s). For example, the nucleotide "T", as used in the unmodified siRNAs sense and antisense strands in Table 1A, for example, SEQ ID Nos: 1-15, 22-36, 43-128, 130-143, 152-315, 322-467, 471-475, 481-487, 489-511, 513, 516-524, 527-856, 868-975, 977-1113, 1115-1133, 1135-1161, and 1163-1212, represents RNA uridine, and the corresponding RNA sense and antisense strands are listed in Table 1F.

In some embodiments, the present disclosure provides an oligonucleotide or RNAi agent, as described herein, or a pharmaceutically acceptable salt thereof. As used herein, the term "pharmaceutically acceptable salt" refers to those salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, S. M. Berge et al., describe pharmaceutically acceptable salts in detail in, J. PHARMACEUTICAL SCIENCES, 1977, (66); 1-19, incorporated herein by reference. Pharmaceutically acceptable salts of the nucleic acids and analogues thereof of this disclosure include those derived from suitable inorganic and organic acids and bases. Salts derived from appropriate bases include alkali metal, alkaline earth metal, ammonium and $N^+(C_{1-4}alkyl)_4$ salts. In some embodiments, a pharmaceutically acceptable salt is the sodium salt. In some embodiments, a pharmaceutically acceptable salt is the potassium salt.

In some embodiments, the oligonucleotide comprises an antisense strand comprising at least 14 contiguous nucleotides (for example, 14, 15, 16, 17, 18, 19, 20, 21, 22, 23, 24, 25, 26, 27, 28, 29, 30, 31, 32, 33, 34, 35, 36, 37, 38, 39, or 40 contiguous nucleotides) substantially complementary to a sequence of nucleotides within a transcript encoding DUX4. In some embodiments, the antisense strand has no more than 5 mismatched nucleotides to the sequence of nucleotides within the transcript encoding DUX4. In some embodiments, the antisense strand has no more than 4 mismatched nucleotides to the sequence of nucleotides within the transcript encoding DUX4. In some embodiments, the antisense strand has no more than 3 mismatched nucleotides to the sequence of nucleotides within the transcript encoding DUX4. In some embodiments, the antisense strand has no more than 2 mismatched nucleotides to the sequence of nucleotides within the transcript encoding DUX4. In some embodiments, the antisense strand has no more than 1 mismatched nucleotides to the sequence of nucleotides within the transcript encoding DUX4. In some embodiments, the antisense strand is completely complementary to the sequence of nucleotides within the transcript encoding DUX4 (e.g., 0 mismatches).

The DUX4 gene encodes a transcription factor that is normally involved in zygotic genome activation during the four-cell stage of early embryonic development. Afterward, DUX4 is epigenetically silenced in all adult tissues apart from the limited expression of unrelated DUX4 isoforms in the testis and thymus. Following transcription of the DUX4 gene, stochastic, low-level DUX4 protein expression occurs in the myofiber nuclei of the skeletal muscle. Inappropriate DUX4 protein expression in adult skeletal muscle is highly toxic and causes Facioscapulohumeral muscular dystrophy (FSHD). DUX4 is a transcription factor comprising a single protein. Exemplary sequences of DUX4 may be found for example at NCBI RefSeq ID NM_001306068.3 (SEQ ID NO: 2425). In some embodiments, DUX4 is encoded by a nucleotide sequence corresponding to the transcript having the NCBI RefSeq ID NM_001306068.3 (SEQ ID NO: 2425).

In some embodiments, the sequence of nucleotides encoding DUX4 comprises a nucleotide sequence having at least 75% nucleotide sequence identity to SEQ ID NO: 2425. In some embodiments, the sequence of nucleotides encoding DUX4 comprises a nucleotide sequence having at least 80% nucleotide sequence identity to SEQ ID NO: 2425. In some embodiments, the sequence of nucleotides encoding DUX4 comprises a nucleotide sequence having at least 85% nucleotide sequence identity to SEQ ID NO: 2425. In some embodiments, the sequence of nucleotides encoding DUX4 comprises a nucleotide sequence having at least 90% nucleotide sequence identity to SEQ ID NO: 2425. In some embodiments, the sequence of nucleotides encoding DUX4 comprises a nucleotide sequence having at least 95% nucleotide sequence identity to SEQ ID NO: 2425. In some embodiments, the sequence of nucleotides encoding DUX4 comprises a nucleotide sequence having at least 99% nucleotide sequence identity to SEQ ID NO: 2425.

In some embodiments, the antisense strand is substantially complementary to a sequence of nucleotides corresponding to an untranslated region of the DUX4 transcript. In some embodiments, the antisense strand is substantially complementary to the sequence of nucleotides corresponding to an untranslated region of the DUX4 transcript with no more than 5, 4, 3, 2, 1, or 0 mismatches. In some embodiments, the antisense strand is completely complementary to the sequence of nucleotides corresponding to an untranslated region of the DUX4 transcript.

RNAi Agents

In some embodiments, the oligonucleotide is an RNAi agent or RNAi trigger for inhibiting expression of DUX4. As used herein, an "RNAi agent" or "RNAi trigger" refers to an oligonucleotide molecule capable of inducing RNA interference (RNAi), which mediates the targeted cleavage of an RNA transcript via an RNA-induced silencing complex (RISC) pathway. The RNAi agents disclosed herein include but are not limited to: short (or small) interfering RNAs (siRNAs), double stranded RNAs (dsRNA), micro RNAs (miRNAs), short hairpin RNAs (shRNA), and dicer substrates (e.g., DsiRNAs).

In some embodiments, the RNAi agent is a double stranded RNA molecule comprising an antisense strand and a sense strand that are complementary to one another and hybridize to form a duplex or double stranded region. One strand of the RNAi agent, the antisense strand or guide strand, includes a region of complementarity to a target sequence in DUX4. The other strand, the sense strand or passenger strand, includes a region that is complementary to the antisense strand, such that the two strands hybridize and form a duplex structure when combined under suitable conditions. In some embodiments, the double stranded RNA molecule may be formed by base pairing between two separate molecules of RNA (e.g., an antisense strand and a sense strand). In some embodiments, the double stranded RNA molecule is a self-complementary molecule formed by intramolecular base pairing between two separate regions of a single RNA molecule (e.g., an antisense region linked to a sense strand through an unpaired RNA linker forming a loop or hairpin loop).

Where the two strands are part of a self-complementary molecule, the connecting RNA chain is referred to as a "hairpin loop." A hairpin loop can comprise at least one unpaired nucleotide. In some embodiments, the hairpin loop can comprise at least 4, at least 5, at least 6, at least 7, at least 8, at least 9, at least 10, at least 20, at least 23 or more unpaired nucleotides or nucleotides not directed to the target site of the dsRNA. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides. In some embodiments, the hairpin loop can contain 1-4 oligoethyne glycols, including ethylene glycol, di ethylene glycol, triethylene glycol, tetraethylene glycol, hexaethylene glycol, or any combination thereof.

Where the two substantially complementary strands of a double stranded RNA molecule comprise separate RNA molecules, those molecules need not, but can be covalently connected. In certain embodiments, where the two strands are connected covalently by means other than an uninterrupted chain of nucleotides between the 3'-end of one strand and the 5'-end of the respective other strand forming the duplex structure, the connecting structure is referred to as a "linker" (though it is noted that certain other structures defined elsewhere herein can also be referred to as a "linker"). The RNA strands may have the same or a different number of nucleotides. The maximum number of base pairs is the number of nucleotides in the shortest strand of the double stranded RNA molecule minus any overhangs that are present in the duplex.

In some embodiments, the RNAi agent is an siRNA.

In some embodiments, the RNAi agent is a shRNA.

In some embodiments, the RNAi agent is a dicer substrate (e.g., a Dicer-substrate siRNA).

In some embodiments, the sense and antisense strands of the dsRNA are each independently about 15 to about 30 nucleotides in length, or about 25 to about 30 nucleotides in length, e.g., each strand is independently between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length.

In some embodiments, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length.

An RNAi agent as described herein can further include one or more single-stranded nucleotide overhangs, e.g., an overhang of 1, 2, 3, or 4 nucleotides. RNAi agent having at least one nucleotide overhang can have unexpectedly superior inhibitory properties relative to their blunt-ended counterparts. A nucleotide overhang can comprise or consist of a nucleotide/nucleoside analog, including a deoxynucleotide, an inverted deoxynucleotide or an inverted abasic nucleotide. The overhang(s) can be on the sense strand, the antisense strand or any combination thereof. Furthermore, the nucleotide(s) of an overhang can be present on the 5'-end, 3'-end or both ends of either an antisense or sense strand of the RNAi agent. In certain embodiments, longer, extended overhangs are possible.

In some embodiments, the antisense strand is 21 nucleotides in length, and the sense strand is 19 nucleotides in length. In some embodiments, the antisense strand is 19 nucleotides in length, and the sense strand is 19 nucleotides in length.

The oligonucleotides disclosed herein may be unmodified or modified (e.g., chemically modified or conjugated). A modified oligonucleotide as disclosed herein comprises an identical nucleobase sequence as compared to a corresponding unmodified oligonucleotide, but further comprises one or more modifications as disclosed herein.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides from any one of the antisense strand sequences of Tables 1A-1F. In some embodiments, the antisense strand differs by no more than 3 nucleotides from any one of the antisense strand sequences of Tables 1A-1F. In some embodiments, the antisense strand differs by no more than 2 nucleotides from any one of the antisense strand sequences of Tables 1A-1F. In some embodiments, the antisense strand differs by no more than 1 nucleotide from any one of the antisense strand sequences of Tables 1A-1F. In some embodiments, the antisense strand comprises any one of the antisense strand sequences of Tables 1A-1F. In some embodiments, the antisense strand consists of any one of the antisense strand sequences of Tables 1A-1F.

In some embodiments, the present disclosure provides oligonucleotides for inhibiting expression of DUX4, wherein the oligonucleotide comprises an antisense strand substantially complementary to a sequence encoding DUX4. In some embodiments, the oligonucleotide targets a sequence corresponding to positions selected from Table 4.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides from the nucleotide sequence of any one of SEQ ID NOs: 607-1212 or 1819-2424. In some embodiments, the antisense strand differs by no more than 3 nucleotides from the nucleotide sequence of any one of SEQ ID NOs: 607-1212 or 1819-2424. In some embodiments, the antisense strand differs by no more than 2 nucleotides from the nucleotide sequence of any one of SEQ ID NOs: 607-1212 or 1819-2424. In some embodiments, the antisense strand differs by no more than 1 nucleotide from the nucleotide sequence of any one of SEQ ID NOs: 607-1212 or 1819-2424. In some embodiments, the antisense strand comprises the nucleotide sequence of any one of SEQ ID NOs: 607-1212 or 1819-2424. In some embodiments, the antisense strand consists of the nucleotide sequence of any one of SEQ ID NOs: 607-1212 or 1819-2424. In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides from the nucleotide sequence of any one of SEQ ID NOs: 2437-2447. In some embodiments, the antisense strand differs by no more than 3 nucleotides from the nucleotide sequence of any one of SEQ ID NOs: 2437-2447. In some embodiments, the antisense strand differs by no more than 2 nucleotides from the nucleotide sequence of any one of SEQ ID NOs: 2437-2447. In some embodiments, the antisense strand differs by no more than 1 nucleotide from the nucleotide sequence of any one of SEQ ID NOs: 2437-2447. In some embodiments, the antisense strand comprises the nucleotide sequence of any one of SEQ ID NOs: 2437-2447. In some embodiments, the antisense strand consists of the nucleotide sequence of any one of SEQ ID NOs: 2437-2447.

In some embodiments, the antisense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to a portion of the nucleotide sequence of any one of SEQ ID NOs: 607-1212 or 1819-2424. In some embodiments, the antisense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to the nucleotide sequence of any one of SEQ ID NOs: 607-1212 or 1819-2424. In some embodiments, the antisense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to a portion of the nucleotide sequence of any one of SEQ ID NOs: 2437-2447. In some embodiments, the antisense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to the nucleotide sequence of any one of SEQ ID NOs: 2437-2447.

In some embodiments, the antisense strand consists of a nucleotide sequence having the nucleotide sequence of any one of SEQ ID NOs: 607-1212 or 1819-2424. In some embodiments, the antisense strand consists of a nucleotide sequence having the nucleotide sequence of any one of SEQ ID NOs: 2437-2447.

In some embodiments, the sense strand comprises a nucleotide sequence comprising at least 15 contiguous nucleotides (for example, 15, 16, 17, 18, or 19 contiguous nucleotides) differing by no more than 4 nucleotides from any one of the sense strand sequences of Tables 1A-1F. In some embodiments, the sense strand differs by no more than 3 nucleotides from any one of the sense strand sequences of Tables 1A-1F. In some embodiments, the sense strand differs by no more than 2 nucleotides from any one of the sense strand sequences of Tables 1A-1F. In some embodiments, the sense strand differs by no more than 1 nucleotide from any one of the sense strand sequences of Tables 1A-1F. In some embodiments, the sense strand comprises a sequence of any one of the sense strands of Tables 1A-1F. In some embodiments, the sense strand consists of a sequence of any one of the sense strands of Tables 1A-1F.

In some embodiments, the sense strand comprises a nucleotide sequence comprising at least 15 contiguous nucleotides (for example, 15, 16, 17, 18, or 19 contiguous nucleotides) differing by no more than 4 nucleotides from the nucleotide sequence of any one of SEQ ID NOs: 1-606 or 1213-1818. In some embodiments, the sense strand differs by no more than 3 nucleotides from the nucleotide sequence of any one of SEQ ID NOs: 1-606 or 1213-1818. In some embodiments, the sense strand differs by no more than 2 nucleotides from the nucleotide sequence of any one of SEQ ID NOs: 1-606 or 1213-1818. In some embodiments, the sense strand differs by no more than 1 nucleotide from the nucleotide sequence of any one of SEQ ID NOs: 1-606 or 1213-1818. In some embodiments, the sense strand comprises the nucleotide sequence of any one of SEQ ID NOs: 1-606 or 1213-1818. In some embodiments, the sense strand consists of the nucleotide sequence of any one of SEQ ID NOs: 1-606 or 1213-1818. In some embodiments, the sense strand comprises a nucleotide sequence comprising at least 15 contiguous nucleotides (for example, 15, 16, 17, 18, or 19 contiguous nucleotides) differing by no more than 4 nucleotides from the nucleotide sequence of any one of SEQ ID NOs: 2426-2436. In some embodiments, the sense strand differs by no more than 3 nucleotides from the nucleotide sequence of any one of SEQ ID NOs: 2426-2436. In some embodiments, the sense strand differs by no more than 2 nucleotides from the nucleotide sequence of any one of SEQ ID NOs: 2426-2436. In some embodiments, the sense strand differs by no more than 1 nucleotide from the nucleotide sequence of any one of SEQ ID NOs: 2426-2436. In some embodiments, the sense strand comprises the nucleotide sequence of any one of SEQ ID NOs: 2426-2436. In some embodiments, the sense strand consists of the nucleotide sequence of any one of SEQ ID NOs: 2426-2436.

In some embodiments, the sense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to a portion of the nucleotide sequence of any one of SEQ ID NOs: 1-606 or 1213-1818. In some embodiments, the sense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to the nucleotide sequence of any one of SEQ ID NOs: 1-606 or 1213-1818. In some embodiments, the sense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to a portion of the nucleotide sequence of any one of SEQ ID NOs: 2426-2436. In some embodiments, the sense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to the nucleotide sequence of any one of SEQ ID NOs: 2426-2436.

In some embodiments, the sense strand consists of a nucleotide sequence having the nucleotide sequence of any one of SEQ ID NOs: 1-606 or 1213-1818. In some embodiments, the sense strand consists of a nucleotide sequence having the nucleotide sequence of any one of SEQ ID NOs: 2426-2436.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides from the nucleotide sequence of any one of SEQ ID NOs: 607-1212 or 1819-2424, and the sense strand comprises a nucleotide sequence at least 15 contiguous nucleotides (for example, 15, 16, 17, 18, or 19 contiguous nucleotides) differing by no more than 4 nucleotides from the nucleotide sequence of any one of SEQ ID NOs: 1-606 or 1213-1818. In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides from the nucleotide sequence of any one of SEQ ID NOs: 2437-2447, and the sense strand comprises a nucleotide sequence at least 15 contiguous nucleotides (for example, 15, 16, 17, 18, or 19 contiguous nucleotides) differing by no more than 4 nucleotides from the nucleotide sequence of any one of SEQ ID NOs: 2426-2436.

In some embodiments, the antisense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to a portion of the nucleotide sequence of any one of SEQ ID NOs: 607-1212 or 1819-2424, and the sense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to a portion of the nucleotide sequence of any one of SEQ ID NOs: 1-606 or 1213-1818. In some embodiments, the antisense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to a portion of the nucleotide sequence of any one of SEQ ID NOs: 2437-2447, and the sense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to a portion of the nucleotide sequence of any one of SEQ ID NOs: 2426-2436.

In some embodiments, the antisense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to the nucleotide sequence of any one of SEQ ID NOs: 607-1212 or 1819-2424, and the sense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to the nucleotide sequence of any one of SEQ ID NOs: 1-606 or 1213-1818. In some embodiments, the antisense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to the nucleotide sequence of any one of SEQ ID NOs: 2437-2447, and the sense strand comprises a nucleotide sequence having at least 90% nucleotide sequence identity (for example, at least 90%, 91%, 92%, 93%, 94%, 95%, 96%, 97%, 98%, 99%, or 100% nucleotide sequence identity) to the nucleotide sequence of any one of SEQ ID NOs: 2426-2436

In some embodiments, the antisense strand consists of a nucleotide sequence of any one of SEQ ID NOs: 607-1212 or 1819-2424, and the sense strand consists of a nucleotide sequence of any one of SEQ ID Nos: 1-606 or 1213-1818. In some embodiments, the antisense strand consists of a nucleotide sequence of any one of SEQ ID NOs: 2437-2447, and the sense strand consists of a nucleotide sequence of any one of SEQ ID Nos: 2426-2436.

In some embodiments, the oligonucleotide of the present disclosure targets a sequence of nucleotides corresponding to any one of positions 11-29, 13-31, 61-79, 67-85, 109-127, 115-133, 124-142, 125-143, 131-149, 133-151, 163-181, 164-182, 165-183, 187-205, 188-206, 203-221, 204-222, 277-295, 292-310, 299-317, 300-318, 301-319, 307-325, 315-333, 316-334, 339-357, 347-365, 348-366, 349-367, 404-422, 412-430, 420-438, 532-550, 533-551, 619-637, 620-638, 621-639, 708-726, 747-765, 748-766, 749-767, 779-797, 781-799, 852-870, 1036-1054, 1100-1118, 1101-1119, 1107-1125, 1109-1127, 1115-1133, 1131-1149, 1132-1150, 1140-1158, 1141-1159, 1147-1165, 1148-1166, 1149-1167, 1163-1181, 1171-1189, 1428-1446, 1619-1637, 1628-1646, 1629-1647, 1635-1653, 1636-1654, 1637-1655, 1638-1656, 1639-1657, 1651-1669, 1652-1670, 1653-1671, 1654-1672, 1655-1673, 1656-1674, 27-45, 28-46, 251-269, 252-270, 317-335, 355-373, 363-381, 437-455, 452-470, 453-471, 547-565, 548-566, 549-567, 565-583, 579-597, 581-599, 588-606, 627-645, 652-670, 659-677, 668-686, 692-710, 715-733, 717-735, 732-750, 733-751, 813-831, 827-845, 843-861, 845-863, 877-895, 892-910, 893-911, 939-957, 956-974, 989-1007, 1028-1046, 1067-1085, 1083-1101, 1084-1102, 1085-1103, 1212-1230, 1213-1231, 1235-1253, 1251-1269, 1260-1278, 1261-1279, 1267-1285, 1268-1286, 1269-1287, 1274-1292, 1279-1297, 1284-1302, 1288-1306, 1389-1407, 1390-1408, 1421-1439, 1427-1445, 1612-1630, or 1613-1631 of SEQ ID NO: 2425 (NM_001306068.3).

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from an antisense strand selected from Table 1C, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from a sense strand selected from Table 1C. In some embodiments, the antisense strand comprises a nucleotide sequence differing by no more than 4 nucleotides (for example, 1, 2, 3, or 4 nucleotides) from an antisense strand selected from Table 1C, and the sense strand comprises a nucleotide sequence differing by no more than 4 nucleotides (for example, 1, 2, 3, or 4 nucleotides) from a sense strand selected from Table 1C. In some embodiments, the antisense strand comprises an antisense strand selected from Table 1C, and the sense strand comprises a sense strand selected from Table 1C. In some embodiments, the antisense strand consists of an antisense strand selected from Table 1C, and the sense strand consists of a sense strand selected from Table 1C.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1821, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1215. In some embodiments, the antisense strand comprises a nucleotide sequence differing by no more than 4 nucleotides (for example, 1, 2, 3, or 4 nucleotides) from SEQ ID NO: 1821, and the sense strand comprises a nucleotide sequence differing by no more than 4 nucleotides (for example, 1, 2, 3, or 4 nucleotides) from SEQ ID NO: 1215. In some embodiments, the antisense strand comprises the nucleotide sequence SEQ ID NO: 1821, and the sense strand comprises the nucleotide sequence SEQ ID NO: 1215. In some embodiments, the antisense strand consists of the nucleotide sequence SEQ ID NO: 1821, and the sense strand consists of the nucleotide sequence SEQ ID NO: 1215.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1823, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1217. In some embodiments, the antisense strand comprises a nucleotide sequence differing by no more than 4 nucleotides (for example, 1, 2, 3, or 4 nucleotides) from SEQ ID NO: 1823, and the sense strand comprises a nucleotide sequence differing by no more than 4 nucleotides (for example, 1, 2, 3, or 4 nucleotides) from SEQ ID NO: 1217. In some embodiments, the antisense strand comprises the nucleotide sequence SEQ ID NO: 1823, and the sense strand comprises the nucleotide sequence SEQ ID NO: 1217. In some embodiments, the antisense strand consists of the nucleotide sequence SEQ ID NO: 1823, and the sense strand consists of the nucleotide sequence SEQ ID NO: 1217.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1846, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1240. In some embodiments, the antisense strand comprises a nucleotide sequence differing by no more than 4 nucleotides (for example, 1, 2, 3, or 4 nucleotides) from SEQ ID NO: 1846, and the sense strand comprises a nucleotide sequence differing by no more than 4 nucleotides (for example, 1, 2, 3, or 4 nucleotides) from SEQ ID NO: 1240. In some embodiments, the antisense strand comprises the nucleotide sequence SEQ ID NO: 1846, and the sense strand comprises the nucleotide sequence SEQ ID NO: 1240. In some embodiments, the antisense strand consists of the nucleotide sequence SEQ ID NO: 1846, and the sense strand consists of the nucleotide sequence SEQ ID NO: 1240.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1852, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1246. In some embodiments, the antisense strand comprises a nucleotide sequence differing by no more than 4 nucleotides (for example, 1, 2, 3, or 4 nucleotides) from SEQ ID NO: 1852, and the sense strand comprises a nucleotide sequence differing by no more than 4 nucleotides (for example, 1, 2, 3, or 4 nucleotides) from SEQ ID NO: 1246. In some embodiments, the antisense strand comprises the nucleotide sequence SEQ ID NO: 1852, and the sense strand comprises the nucleotide sequence SEQ ID NO: 1246. In some embodiments, the antisense strand consists of the nucleotide sequence SEQ ID NO: 1852, and the sense strand consists of the nucleotide sequence SEQ ID NO: 1246.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1870, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1264. In some embodiments, the antisense strand comprises a nucleotide sequence differing by no more than 4 nucleotides (for example, 1, 2, 3, or 4 nucleotides) from SEQ ID NO: 1870, and the sense strand comprises a nucleotide sequence differing by no more than 4 nucleotides (for example, 1, 2, 3, or 4 nucleotides) from SEQ ID NO: 1264. In some embodiments, the antisense strand comprises the nucleotide sequence SEQ ID NO: 1870, and the sense strand comprises the nucleotide sequence SEQ ID NO: 1264. In some embodiments, the antisense strand consists of the nucleotide sequence SEQ ID NO: 1870, and the sense strand consists of the nucleotide sequence SEQ ID NO: 1264.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1876, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1270. In some embodiments, the antisense strand comprises a nucleotide sequence differing by no more than 4 nucleotides (for example, 1, 2, 3, or 4 nucleotides) from SEQ ID NO: 1876, and the sense strand comprises a nucleotide sequence differing by no more than 4 nucleotides (for example, 1, 2, 3, or 4 nucleotides) from SEQ ID NO: 1270. In some embodiments, the antisense strand comprises the nucleotide sequence SEQ ID NO: 1876, and the sense strand comprises the nucleotide sequence SEQ ID NO: 1270. In some embodiments, the antisense strand consists of the nucleotide sequence SEQ ID NO: 1876, and the sense strand consists of the nucleotide sequence SEQ ID NO: 1270.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1878, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1272. In some embodiments, the antisense strand comprises a nucleotide sequence differing by no more than 4 nucleotides (for example, 1, 2, 3, or 4 nucleotides) from SEQ ID NO: 1878, and the sense strand comprises a nucleotide sequence differing by no more than 4 nucleotides (for example, 1, 2, 3, or 4 nucleotides) from SEQ ID NO: 1272. In some embodiments, the antisense strand comprises the nucleotide sequence SEQ ID NO: 1878, and the sense strand comprises the nucleotide sequence SEQ ID NO: 1272. In some embodiments, the antisense strand consists of the nucleotide sequence SEQ ID NO: 1878, and the sense strand consists of the nucleotide sequence SEQ ID NO: 1272.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1879, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1273. In some embodiments, the antisense strand comprises a nucleotide sequence differing by no more than 4 nucleotides (for example, 1, 2, 3, or 4 nucleotides) from SEQ ID NO: 1879, and the sense strand comprises a nucleotide sequence differing by no more than 4 nucleotides (for example, 1, 2, 3, or 4 nucleotides) from SEQ ID NO: 1273. In some embodiments, the antisense strand comprises the nucleotide sequence SEQ ID NO: 1879, and the sense strand comprises the nucleotide sequence SEQ ID NO: 1273. In some embodiments, the antisense strand consists of the nucleotide sequence SEQ ID NO: 1879, and the sense strand consists of the nucleotide sequence SEQ ID NO: 1273.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1884, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1278. In some embodiments, the antisense strand comprises a nucleotide sequence differing by no more than 4 nucleotides (for example, 1, 2, 3, or 4 nucleotides) from SEQ ID NO: 1884, and the sense strand comprises a nucleotide sequence differing by no more than 4 nucleotides (for example, 1, 2, 3, or 4 nucleotides) from SEQ ID NO: 1278. In some embodiments, the antisense strand comprises the nucleotide sequence SEQ ID NO: 1884, and the sense strand comprises the nucleotide sequence SEQ ID NO: 1278. In some embodiments, the antisense strand consists of the nucleotide sequence SEQ ID NO: 1884, and the sense strand consists of the nucleotide sequence SEQ ID NO: 1278.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1886, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1280. In some embodiments, the antisense strand comprises a nucleotide sequence differing by no more than 4 nucleotides (for example, 1, 2, 3, or 4 nucleotides) from SEQ ID NO: 1886, and the sense strand comprises a nucleotide sequence differing by no more than 4 nucleotides (for example, 1, 2, 3, or 4 nucleotides) from SEQ ID NO: 1280. In some embodiments, the antisense strand comprises the nucleotide sequence SEQ ID NO: 1886, and the sense strand comprises the nucleotide sequence SEQ ID NO: 1280. In some embodiments, the antisense strand consists of the nucleotide sequence SEQ ID NO: 1886, and the sense strand consists of the nucleotide sequence SEQ ID NO: 1280.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1903, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1297. In some embodiments, the antisense strand comprises a nucleotide sequence differing by no more than 4 nucleotides (for example, 1, 2, 3, or 4 nucleotides) from SEQ ID NO: 1903, and the sense strand comprises a nucleotide sequence differing by no more than 4 nucleotides (for example, 1, 2, 3, or 4 nucleotides) from SEQ ID NO: 1297. In some embodiments, the antisense strand comprises the nucleotide sequence SEQ ID NO: 1903, and the sense strand comprises the nucleotide sequence SEQ ID NO: 1297. In some embodiments, the antisense strand consists of the nucleotide sequence SEQ ID NO: 1903, and the sense strand consists of the nucleotide sequence SEQ ID NO: 1297.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1904, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1298. In some embodiments, the antisense strand comprises a nucleotide sequence differing by no more than 4 nucleotides (for example, 1, 2, 3, or 4 nucleotides) from SEQ ID NO: 1904, and the sense strand comprises a nucleotide sequence differing by no more than 4 nucleotides (for example, 1, 2, 3, or 4 nucleotides) from SEQ ID NO: 1298. In some embodiments, the antisense strand comprises the nucleotide sequence SEQ ID NO: 1904, and the sense strand comprises the nucleotide sequence SEQ ID NO: 1298. In some embodiments, the antisense strand consists of the nucleotide sequence SEQ ID NO: 1904, and the sense strand consists of the nucleotide sequence SEQ ID NO: 1298.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1905, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1299. In some embodiments, the antisense strand comprises a nucleotide sequence differing by no more than 4 nucleotides (for example, 1, 2, 3, or 4 nucleotides) from SEQ ID NO: 1905, and the sense strand comprises a nucleotide sequence differing by no more than 4 nucleotides (for example, 1, 2, 3, or 4 nucleotides) from SEQ ID NO: 1299. In some embodiments, the antisense strand comprises the nucleotide sequence SEQ ID NO: 1905, and the sense strand comprises the nucleotide sequence SEQ ID NO: 1299. In some embodiments, the antisense strand consists of the nucleotide sequence SEQ ID NO: 1905, and the sense strand consists of the nucleotide sequence SEQ ID NO: 1299.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1919, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1313. In some embodiments, the antisense strand comprises a nucleotide sequence differing by no more than 4 nucleotides (for example, 1, 2, 3, or 4 nucleotides) from SEQ ID NO: 1919, and the sense strand comprises a nucleotide sequence differing by no more than 4 nucleotides (for example, 1, 2, 3, or 4 nucleotides) from SEQ ID NO: 1313. In some embodiments, the antisense strand comprises the nucleotide sequence SEQ ID NO: 1919, and the sense strand comprises the nucleotide sequence SEQ ID NO: 1313. In some embodiments, the antisense strand consists of the nucleotide sequence SEQ ID NO: 1919, and the sense strand consists of the nucleotide sequence SEQ ID NO: 1313.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1920, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1314. In some embodiments, the antisense strand comprises a nucleotide sequence differing by no more than 4 nucleotides (for example, 1, 2, 3, or 4 nucleotides) from SEQ ID NO: 1920, and the sense strand comprises a nucleotide sequence differing by no more than 4 nucleotides (for example, 1, 2, 3, or 4 nucleotides) from SEQ ID NO: 1314. In some embodiments, the antisense strand comprises the nucleotide sequence SEQ ID NO: 1920, and the sense strand comprises the nucleotide sequence SEQ ID NO: 1314. In some embodiments, the antisense strand consists of the nucleotide sequence SEQ ID NO: 1920, and the sense strand consists of the nucleotide sequence SEQ ID NO: 1314.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1933, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1327. In some embodiments, the antisense strand comprises a nucleotide sequence differing by no more than 4 nucleotides (for example, 1, 2, 3, or 4 nucleotides) from SEQ ID NO: 1933, and the sense strand comprises a nucleotide sequence differing by no more than 4 nucleotides (for example, 1, 2, 3, or 4 nucleotides) from SEQ ID NO: 1327. In some embodiments, the antisense strand comprises the nucleotide sequence SEQ ID NO: 1933, and the sense strand comprises the nucleotide sequence SEQ ID NO: 1327. In some embodiments, the antisense strand consists of the nucleotide sequence SEQ ID NO: 1933, and the sense strand consists of the nucleotide sequence SEQ ID NO: 1327.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1934, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1328. In some embodiments, the antisense strand comprises a nucleotide sequence differing by no more than 4 nucleotides (for example, 1, 2, 3, or 4 nucleotides) from SEQ ID NO: 1934, and the sense strand comprises a nucleotide sequence differing by no more than 4 nucleotides (for example, 1, 2, 3, or 4 nucleotides) from SEQ ID NO: 1328. In some embodiments, the antisense strand comprises the nucleotide sequence SEQ ID NO: 1934, and the sense strand comprises the nucleotide sequence SEQ ID NO: 1328. In some embodiments, the antisense strand consists of the nucleotide sequence SEQ ID NO: 1934, and the sense strand consists of the nucleotide sequence SEQ ID NO: 1328.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1968, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1362. In some embodiments, the antisense strand comprises a nucleotide sequence differing by no more than 4 nucleotides (for example, 1, 2, 3, or 4 nucleotides) from SEQ ID NO: 1968, and the sense strand comprises a nucleotide sequence differing by no more than 4 nucleotides (for example, 1, 2, 3, or 4 nucleotides) from SEQ ID NO: 1362. In some embodiments, the antisense strand comprises the nucleotide sequence SEQ ID NO: 1968, and the sense strand comprises the nucleotide sequence SEQ ID NO: 1362. In some embodiments, the antisense strand consists of the nucleotide sequence SEQ ID NO: 1968, and the sense strand consists of the nucleotide sequence SEQ ID NO: 1362.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1975, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1369. In some embodiments, the antisense strand comprises a nucleotide sequence differing by no more than 4 nucleotides (for example, 1, 2, 3, or 4 nucleotides) from SEQ ID NO: 1975, and the sense strand comprises a nucleotide sequence differing by no more than 4 nucleotides (for example, 1, 2, 3, or 4 nucleotides) from SEQ ID NO: 1369. In some embodiments, the antisense strand comprises the nucleotide sequence SEQ ID NO: 1975, and the sense strand comprises the nucleotide sequence SEQ ID NO: 1369. In some embodiments, the antisense strand consists of the nucleotide sequence SEQ ID NO: 1975, and the sense strand consists of the nucleotide sequence SEQ ID NO: 1369.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1982, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1376. In some embodiments, the antisense strand comprises a nucleotide sequence differing by no more than 4 nucleotides (for example, 1, 2, 3, or 4 nucleotides) from SEQ ID NO: 1982, and the sense strand comprises a nucleotide sequence differing by no more than 4 nucleotides (for example, 1, 2, 3, or 4 nucleotides) from SEQ ID NO: 1376. In some embodiments, the antisense strand comprises the nucleotide sequence SEQ ID NO: 1982, and the sense strand comprises the nucleotide sequence SEQ ID NO: 1376. In some embodiments, the antisense strand consists of the nucleotide sequence SEQ ID NO: 1982, and the sense strand consists of the nucleotide sequence SEQ ID NO: 1376.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1983, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1377. In some embodiments, the antisense strand comprises a nucleotide sequence differing by no more than 4 nucleotides (for example, 1, 2, 3, or 4 nucleotides) from SEQ ID NO: 1983, and the sense strand comprises a nucleotide sequence differing by no more than 4 nucleotides (for example, 1, 2, 3, or 4 nucleotides) from SEQ ID NO: 1377. In some embodiments, the antisense strand comprises the nucleotide sequence SEQ ID NO: 1983, and the sense strand comprises the nucleotide sequence SEQ ID NO: 1377. In some embodiments, the antisense strand consists of the nucleotide sequence SEQ ID NO: 1983, and the sense strand consists of the nucleotide sequence SEQ ID NO: 1377.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1984, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1378. In some embodiments, the antisense strand comprises a nucleotide sequence differing by no more than 4 nucleotides (for example, 1, 2, 3, or 4 nucleotides) from SEQ ID NO: 1984, and the sense strand comprises a nucleotide sequence differing by no more than 4 nucleotides (for example, 1, 2, 3, or 4 nucleotides) from SEQ ID NO: 1378. In some embodiments, the antisense strand comprises the nucleotide sequence SEQ ID NO: 1984, and the sense strand comprises the nucleotide sequence SEQ ID NO: 1378. In some embodiments, the antisense strand consists of the nucleotide sequence SEQ ID NO: 1984, and the sense strand consists of the nucleotide sequence SEQ ID NO: 1378.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1990, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1384. In some embodiments, the antisense strand comprises a nucleotide sequence differing by no more than 4 nucleotides (for example, 1, 2, 3, or 4 nucleotides) from SEQ ID NO: 1990, and the sense strand comprises a nucleotide sequence differing by no more than 4 nucleotides (for example, 1, 2, 3, or 4 nucleotides) from SEQ ID NO: 1384. In some embodiments, the antisense strand comprises the nucleotide sequence SEQ ID NO: 1990, and the sense strand comprises the nucleotide sequence SEQ ID NO: 1384. In some embodiments, the antisense strand consists of the nucleotide sequence SEQ ID NO: 1990, and the sense strand consists of the nucleotide sequence SEQ ID NO: 1384.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1998, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1392. In some embodiments, the antisense strand comprises a nucleotide sequence differing by no more than 4 nucleotides (for example, 1, 2, 3, or 4 nucleotides) from SEQ ID NO: 1998, and the sense strand comprises a nucleotide sequence differing by no more than 4 nucleotides (for example, 1, 2, 3, or 4 nucleotides) from SEQ ID NO: 1392. In some embodiments, the antisense strand comprises the nucleotide sequence SEQ ID NO: 1998, and the sense strand comprises the nucleotide sequence SEQ ID NO: 1392. In some embodiments, the antisense strand consists of the nucleotide sequence SEQ ID NO: 1998, and the sense strand consists of the nucleotide sequence SEQ ID NO: 1392.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1999, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1393. In some embodiments, the antisense strand comprises a nucleotide sequence differing by no more than 4 nucleotides (for example, 1, 2, 3, or 4 nucleotides) from SEQ ID NO: 1999, and the sense strand comprises a nucleotide sequence differing by no more than 4 nucleotides (for example, 1, 2, 3, or 4 nucleotides) from SEQ ID NO: 1393. In some embodiments, the antisense strand comprises the nucleotide sequence SEQ ID NO: 1999, and the sense strand comprises the nucleotide sequence SEQ ID NO: 1393. In some embodiments, the antisense strand consists of the nucleotide sequence SEQ ID NO: 1999, and the sense strand consists of the nucleotide sequence SEQ ID NO: 1393.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2005, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1399. In some embodiments, the antisense strand comprises a nucleotide sequence differing by no more than 4 nucleotides (for example, 1, 2, 3, or 4 nucleotides) from SEQ ID NO: 2005, and the sense strand comprises a nucleotide sequence differing by no more than 4 nucleotides (for example, 1, 2, 3, or 4 nucleotides) from SEQ ID NO: 1399. In some embodiments, the antisense strand comprises the nucleotide sequence SEQ ID NO: 2005, and the sense strand comprises the nucleotide sequence SEQ ID NO: 1399. In some embodiments, the antisense strand consists of the nucleotide sequence SEQ ID NO: 2005, and the sense strand consists of the nucleotide sequence SEQ ID NO: 1399.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2013, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1407. In some embodiments, the antisense strand comprises a nucleotide sequence differing by no more than 4 nucleotides (for example, 1, 2, 3, or 4 nucleotides) from SEQ ID NO: 2013, and the sense strand comprises a nucleotide sequence differing by no more than 4 nucleotides (for example, 1, 2, 3, or 4 nucleotides) from SEQ ID NO: 1407. In some embodiments, the antisense strand comprises the nucleotide sequence SEQ ID NO: 2013, and the sense strand comprises the nucleotide sequence SEQ ID NO: 1407. In some embodiments, the antisense strand consists of the nucleotide sequence SEQ ID NO: 2013, and the sense strand consists of the nucleotide sequence SEQ ID NO: 1407.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2014, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1408. In some embodiments, the antisense strand comprises a nucleotide sequence differing by no more than 4 nucleotides (for example, 1, 2, 3, or 4 nucleotides) from SEQ ID NO: 2014, and the sense strand comprises a nucleotide sequence differing by no more than 4 nucleotides (for example, 1, 2, 3, or 4 nucleotides) from SEQ ID NO: 1408. In some embodiments, the antisense strand comprises the nucleotide sequence SEQ ID NO: 2014, and the sense strand comprises the nucleotide sequence SEQ ID NO: 1408. In some embodiments, the antisense strand consists of the nucleotide sequence SEQ ID NO: 2014, and the sense strand consists of the nucleotide sequence SEQ ID NO: 1408.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2015, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1409. In some embodiments, the antisense strand comprises a nucleotide sequence differing by no more than 4 nucleotides (for example, 1, 2, 3, or 4 nucleotides) from SEQ ID NO: 2015, and the sense strand comprises a nucleotide sequence differing by no more than 4 nucleotides (for example, 1, 2, 3, or 4 nucleotides) from SEQ ID NO: 1409. In some embodiments, the antisense strand comprises the nucleotide sequence SEQ ID NO: 2015, and the sense strand comprises the nucleotide sequence SEQ ID NO: 1409. In some embodiments, the antisense strand consists of the nucleotide sequence SEQ ID NO: 2015, and the sense strand consists of the nucleotide sequence SEQ ID NO: 1409.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2044, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1438. In some embodiments, the antisense strand comprises a nucleotide sequence differing by no more than 4 nucleotides (for example, 1, 2, 3, or 4 nucleotides) from SEQ ID NO: 2044, and the sense strand comprises a nucleotide sequence differing by no more than 4 nucleotides (for example, 1, 2, 3, or 4 nucleotides) from SEQ ID NO: 1438. In some embodiments, the antisense strand comprises the nucleotide sequence SEQ ID NO: 2044, and the sense strand comprises the nucleotide sequence SEQ ID NO: 1438. In some embodiments, the antisense strand consists of the nucleotide sequence SEQ ID NO: 2044, and the sense strand consists of the nucleotide sequence SEQ ID NO: 1438.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2049, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1443. In some embodiments, the antisense strand comprises a nucleotide sequence differing by no more than 4 nucleotides (for example, 1, 2, 3, or 4 nucleotides) from SEQ ID NO: 2049, and the sense strand comprises a nucleotide sequence differing by no more than 4 nucleotides (for example, 1, 2, 3, or 4 nucleotides) from SEQ ID NO: 1443. In some embodiments, the antisense strand comprises the nucleotide sequence SEQ ID NO: 2049, and the sense strand comprises the nucleotide sequence SEQ ID NO: 1443. In some embodiments, the antisense strand consists of the nucleotide sequence SEQ ID NO: 2049, and the sense strand consists of the nucleotide sequence SEQ ID NO: 1443.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2050, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1444. In some embodiments, the antisense strand comprises a nucleotide sequence differing by no more than 4 nucleotides (for example, 1, 2, 3, or 4 nucleotides) from SEQ ID NO: 2050, and the sense strand comprises a nucleotide sequence differing by no more than 4 nucleotides (for example, 1, 2, 3, or 4 nucleotides) from SEQ ID NO: 1444. In some embodiments, the antisense strand comprises the nucleotide sequence SEQ ID NO: 2050, and the sense strand comprises the nucleotide sequence SEQ ID NO: 1444. In some embodiments, the antisense strand consists of the nucleotide sequence SEQ ID NO: 2050, and the sense strand consists of the nucleotide sequence SEQ ID NO: 1444.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2082, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1476. In some embodiments, the antisense strand comprises a nucleotide sequence differing by no more than 4 nucleotides (for example, 1, 2, 3, or 4 nucleotides) from SEQ ID NO: 2082, and the sense strand comprises a nucleotide sequence differing by no more than 4 nucleotides (for example, 1, 2, 3, or 4 nucleotides) from SEQ ID NO: 1476. In some embodiments, the antisense strand comprises the nucleotide sequence SEQ ID NO: 2082, and the sense strand comprises the nucleotide sequence SEQ ID NO: 1476. In some embodiments, the antisense strand consists of the nucleotide sequence SEQ ID NO: 2082, and the sense strand consists of the nucleotide sequence SEQ ID NO: 1476.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2083, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1477. In some embodiments, the antisense strand comprises a nucleotide sequence differing by no more than 4 nucleotides (for example, 1, 2, 3, or 4 nucleotides) from SEQ ID NO: 2083, and the sense strand comprises a nucleotide sequence differing by no more than 4 nucleotides (for example, 1, 2, 3, or 4 nucleotides) from SEQ ID NO: 1477. In some embodiments, the antisense strand comprises the nucleotide sequence SEQ ID NO: 2083, and the sense strand comprises the nucleotide sequence SEQ ID NO: 1477. In some embodiments, the antisense strand consists of the nucleotide sequence SEQ ID NO: 2083, and the sense strand consists of the nucleotide sequence SEQ ID NO: 1477.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2090, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1484. In some embodiments, the antisense strand comprises a nucleotide sequence differing by no more than 4 nucleotides (for example, 1, 2, 3, or 4 nucleotides) from SEQ ID NO: 2090, and the sense strand comprises a nucleotide sequence differing by no more than 4 nucleotides (for example, 1, 2, 3, or 4 nucleotides) from SEQ ID NO: 1484. In some embodiments, the antisense strand comprises the nucleotide sequence SEQ ID NO: 2090, and the sense strand comprises the nucleotide sequence SEQ ID NO: 1484. In some embodiments, the antisense strand consists of the nucleotide sequence SEQ ID NO: 2090, and the sense strand consists of the nucleotide sequence SEQ ID NO: 1484.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2091, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1485. In some embodiments, the antisense strand comprises a nucleotide sequence differing by no more than 4 nucleotides (for example, 1, 2, 3, or 4 nucleotides) from SEQ ID NO: 2091, and the sense strand comprises a nucleotide sequence differing by no more than 4 nucleotides (for example, 1, 2, 3, or 4 nucleotides) from SEQ ID NO: 1485. In some embodiments, the antisense strand comprises the nucleotide sequence SEQ ID NO: 2091, and the sense strand comprises the nucleotide sequence SEQ ID NO: 1485. In some embodiments, the antisense strand consists of the nucleotide sequence SEQ ID NO: 2091, and the sense strand consists of the nucleotide sequence SEQ ID NO: 1485.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2092, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1486. In some embodiments, the antisense strand comprises a nucleotide sequence differing by no more than 4 nucleotides (for example, 1, 2, 3, or 4 nucleotides) from SEQ ID NO: 2092, and the sense strand comprises a nucleotide sequence differing by no more than 4 nucleotides (for example, 1, 2, 3, or 4 nucleotides) from SEQ ID NO: 1486. In some embodiments, the antisense strand comprises the nucleotide sequence SEQ ID NO: 2092, and the sense strand comprises the nucleotide sequence SEQ ID NO: 1486. In some embodiments, the antisense strand consists of the nucleotide sequence SEQ ID NO: 2092, and the sense strand consists of the nucleotide sequence SEQ ID NO: 1486.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2105, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1499. In some embodiments, the antisense strand comprises a nucleotide sequence differing by no more than 4 nucleotides (for example, 1, 2, 3, or 4 nucleotides) from SEQ ID NO: 2105, and the sense strand comprises a nucleotide sequence differing by no more than 4 nucleotides (for example, 1, 2, 3, or 4 nucleotides) from SEQ ID NO: 1499. In some embodiments, the antisense strand comprises the nucleotide sequence SEQ ID NO: 2105, and the sense strand comprises the nucleotide sequence SEQ ID NO: 1499. In some embodiments, the antisense strand consists of the nucleotide sequence SEQ ID NO: 2105, and the sense strand consists of the nucleotide sequence SEQ ID NO: 1499.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2113, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1507. In some embodiments, the antisense strand comprises a nucleotide sequence differing by no more than 4 nucleotides (for example, 1, 2, 3, or 4 nucleotides) from SEQ ID NO: 2113, and the sense strand comprises a nucleotide sequence differing by no more than 4 nucleotides (for example, 1, 2, 3, or 4 nucleotides) from SEQ ID NO: 1507. In some embodiments, the antisense strand comprises the nucleotide sequence SEQ ID NO: 2113, and the sense strand comprises the nucleotide sequence SEQ ID NO: 1507. In some embodiments, the antisense strand consists of the nucleotide sequence SEQ ID NO: 2113, and the sense strand consists of the nucleotide sequence SEQ ID NO: 1507.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2114, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1508. In some embodiments, the antisense strand comprises a nucleotide sequence differing by no more than 4 nucleotides (for example, 1, 2, 3, or 4 nucleotides) from SEQ ID NO: 2114, and the sense strand comprises a nucleotide sequence differing by no more than 4 nucleotides (for example, 1, 2, 3, or 4 nucleotides) from SEQ ID NO: 1508. In some embodiments, the antisense strand comprises the nucleotide sequence SEQ ID NO: 2114, and the sense strand comprises the nucleotide sequence SEQ ID NO: 1508. In some embodiments, the antisense strand consists of the nucleotide sequence SEQ ID NO: 2114, and the sense strand consists of the nucleotide sequence SEQ ID NO: 1508.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2115, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1509. In some embodiments, the antisense strand comprises a nucleotide sequence differing by no more than 4 nucleotides (for example, 1, 2, 3, or 4 nucleotides) from SEQ ID NO: 2115, and the sense strand comprises a nucleotide sequence differing by no more than 4 nucleotides (for example, 1, 2, 3, or 4 nucleotides) from SEQ ID NO: 1509. In some embodiments, the antisense strand comprises the nucleotide sequence SEQ ID NO: 2115, and the sense strand comprises the nucleotide sequence SEQ ID NO: 1509. In some embodiments, the antisense strand consists of the nucleotide sequence SEQ ID NO: 2115, and the sense strand consists of the nucleotide sequence SEQ ID NO: 1509.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2132, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1526. In some embodiments, the antisense strand comprises a nucleotide sequence differing by no more than 4 nucleotides (for example, 1, 2, 3, or 4 nucleotides) from SEQ ID NO: 2132, and the sense strand comprises a nucleotide sequence differing by no more than 4 nucleotides (for example, 1, 2, 3, or 4 nucleotides) from SEQ ID NO: 1526. In some embodiments, the antisense strand comprises the nucleotide sequence SEQ ID NO: 2132, and the sense strand comprises the nucleotide sequence SEQ ID NO: 1526. In some embodiments, the antisense strand consists of the nucleotide sequence SEQ ID NO: 2132, and the sense strand consists of the nucleotide sequence SEQ ID NO: 1526.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2134, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1528. In some embodiments, the antisense strand comprises a nucleotide sequence differing by no more than 4 nucleotides (for example, 1, 2, 3, or 4 nucleotides) from SEQ ID NO: 2134, and the sense strand comprises a nucleotide sequence differing by no more than 4 nucleotides (for example, 1, 2, 3, or 4 nucleotides) from SEQ ID NO: 1528. In some embodiments, the antisense strand comprises the nucleotide sequence SEQ ID NO: 2134, and the sense strand comprises the nucleotide sequence SEQ ID NO: 1528. In some embodiments, the antisense strand consists of the nucleotide sequence SEQ ID NO: 2134, and the sense strand consists of the nucleotide sequence SEQ ID NO: 1528.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2143, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1537. In some embodiments, the antisense strand comprises a nucleotide sequence differing by no more than 4 nucleotides (for example, 1, 2, 3, or 4 nucleotides) from SEQ ID NO: 2143, and the sense strand comprises a nucleotide sequence differing by no more than 4 nucleotides (for example, 1, 2, 3, or 4 nucleotides) from SEQ ID NO: 1537. In some embodiments, the antisense strand comprises the nucleotide sequence SEQ ID NO: 2143, and the sense strand comprises the nucleotide sequence SEQ ID NO: 1537. In some embodiments, the antisense strand consists of the nucleotide sequence SEQ ID NO: 2143, and the sense strand consists of the nucleotide sequence SEQ ID NO: 1537.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2167, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1561. In some embodiments, the antisense strand comprises a nucleotide sequence differing by no more than 4 nucleotides (for example, 1, 2, 3, or 4 nucleotides) from SEQ ID NO: 2167, and the sense strand comprises a nucleotide sequence differing by no more than 4 nucleotides (for example, 1, 2, 3, or 4 nucleotides) from SEQ ID NO: 1561. In some embodiments, the antisense strand comprises the nucleotide sequence SEQ ID NO: 2167, and the sense strand comprises the nucleotide sequence SEQ ID NO: 1561. In some embodiments, the antisense strand consists of the nucleotide sequence SEQ ID NO: 2167, and the sense strand consists of the nucleotide sequence SEQ ID NO: 1561.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2186, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1580. In some embodiments, the antisense strand comprises a nucleotide sequence differing by no more than 4 nucleotides (for example, 1, 2, 3, or 4 nucleotides) from SEQ ID NO: 2186, and the sense strand comprises a nucleotide sequence differing by no more than 4 nucleotides (for example, 1, 2, 3, or 4 nucleotides) from SEQ ID NO: 1580. In some embodiments, the antisense strand comprises the nucleotide sequence SEQ ID NO: 2186, and the sense strand comprises the nucleotide sequence SEQ ID NO: 1580. In some embodiments, the antisense strand consists of the nucleotide sequence SEQ ID NO: 2186, and the sense strand consists of the nucleotide sequence SEQ ID NO: 1580.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2187, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1581. In some embodiments, the antisense strand comprises a nucleotide sequence differing by no more than 4 nucleotides (for example, 1, 2, 3, or 4 nucleotides) from SEQ ID NO: 2187, and the sense strand comprises a nucleotide sequence differing by no more than 4 nucleotides (for example, 1, 2, 3, or 4 nucleotides) from SEQ ID NO: 1581. In some embodiments, the antisense strand comprises the nucleotide sequence SEQ ID NO: 2187, and the sense strand comprises the nucleotide sequence SEQ ID NO: 1581. In some embodiments, the antisense strand consists of the nucleotide sequence SEQ ID NO: 2187, and the sense strand consists of the nucleotide sequence SEQ ID NO: 1581.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2190, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1584. In some embodiments, the antisense strand comprises a nucleotide sequence differing by no more than 4 nucleotides (for example, 1, 2, 3, or 4 nucleotides) from SEQ ID NO: 2190, and the sense strand comprises a nucleotide sequence differing by no more than 4 nucleotides (for example, 1, 2, 3, or 4 nucleotides) from SEQ ID NO: 1584. In some embodiments, the antisense strand comprises the nucleotide sequence SEQ ID NO: 2190, and the sense strand comprises the nucleotide sequence SEQ ID NO: 1584. In some embodiments, the antisense strand consists of the nucleotide sequence SEQ ID NO: 2190, and the sense strand consists of the nucleotide sequence SEQ ID NO: 1584.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2192, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1586. In some embodiments, the antisense strand comprises a nucleotide sequence differing by no more than 4 nucleotides (for example, 1, 2, 3, or 4 nucleotides) from SEQ ID NO: 2192, and the sense strand comprises a nucleotide sequence differing by no more than 4 nucleotides (for example, 1, 2, 3, or 4 nucleotides) from SEQ ID NO: 1586. In some embodiments, the antisense strand comprises the nucleotide sequence SEQ ID NO: 2192, and the sense strand comprises the nucleotide sequence SEQ ID NO: 1586. In some embodiments, the antisense strand consists of the nucleotide sequence SEQ ID NO: 2192, and the sense strand consists of the nucleotide sequence SEQ ID NO: 1586.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2198, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1592. In some embodiments, the antisense strand comprises a nucleotide sequence differing by no more than 4 nucleotides (for example, 1, 2, 3, or 4 nucleotides) from SEQ ID NO: 2198, and the sense strand comprises a nucleotide sequence differing by no more than 4 nucleotides (for example, 1, 2, 3, or 4 nucleotides) from SEQ ID NO: 1592. In some embodiments, the antisense strand comprises the nucleotide sequence SEQ ID NO: 2198, and the sense strand comprises the nucleotide sequence SEQ ID NO: 1592. In some embodiments, the antisense strand consists of the nucleotide sequence SEQ ID NO: 2198, and the sense strand consists of the nucleotide sequence SEQ ID NO: 1592.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2204, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1598. In some embodiments, the antisense strand comprises a nucleotide sequence differing by no more than 4 nucleotides (for example, 1, 2, 3, or 4 nucleotides) from SEQ ID NO: 2204, and the sense strand comprises a nucleotide sequence differing by no more than 4 nucleotides (for example, 1, 2, 3, or 4 nucleotides) from SEQ ID NO: 1598. In some embodiments, the antisense strand comprises the nucleotide sequence SEQ ID NO: 2204, and the sense strand comprises the nucleotide sequence SEQ ID NO: 1598. In some embodiments, the antisense strand consists of the nucleotide sequence SEQ ID NO: 2204, and the sense strand consists of the nucleotide sequence SEQ ID NO: 1598.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2205, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1599. In some embodiments, the antisense strand comprises a nucleotide sequence differing by no more than 4 nucleotides (for example, 1, 2, 3, or 4 nucleotides) from SEQ ID NO: 2205, and the sense strand comprises a nucleotide sequence differing by no more than 4 nucleotides (for example, 1, 2, 3, or 4 nucleotides) from SEQ ID NO: 1599. In some embodiments, the antisense strand comprises the nucleotide sequence SEQ ID NO: 2205, and the sense strand comprises the nucleotide sequence SEQ ID NO: 1599. In some embodiments, the antisense strand consists of the nucleotide sequence SEQ ID NO: 2205, and the sense strand consists of the nucleotide sequence SEQ ID NO: 1599.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2209, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1603. In some embodiments, the antisense strand comprises a nucleotide sequence differing by no more than 4 nucleotides (for example, 1, 2, 3, or 4 nucleotides) from SEQ ID NO: 2209, and the sense strand comprises a nucleotide sequence differing by no more than 4 nucleotides (for example, 1, 2, 3, or 4 nucleotides) from SEQ ID NO: 1603. In some embodiments, the antisense strand comprises the nucleotide sequence SEQ ID NO: 2209, and the sense strand comprises the nucleotide sequence SEQ ID NO: 1603. In some embodiments, the antisense strand consists of the nucleotide sequence SEQ ID NO: 2209, and the sense strand consists of the nucleotide sequence SEQ ID NO: 1603.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2210, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1604. In some embodiments, the antisense strand comprises a nucleotide sequence differing by no more than 4 nucleotides (for example, 1, 2, 3, or 4 nucleotides) from SEQ ID NO: 2210, and the sense strand comprises a nucleotide sequence differing by no more than 4 nucleotides (for example, 1, 2, 3, or 4 nucleotides) from SEQ ID NO: 1604. In some embodiments, the antisense strand comprises the nucleotide sequence SEQ ID NO: 2210, and the sense strand comprises the nucleotide sequence SEQ ID NO: 1604. In some embodiments, the antisense strand consists of the nucleotide sequence SEQ ID NO: 2210, and the sense strand consists of the nucleotide sequence SEQ ID NO: 1604.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2216, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1610. In some embodiments, the antisense strand comprises a nucleotide sequence differing by no more than 4 nucleotides (for example, 1, 2, 3, or 4 nucleotides) from SEQ ID NO: 2216, and the sense strand comprises a nucleotide sequence differing by no more than 4 nucleotides (for example, 1, 2, 3, or 4 nucleotides) from SEQ ID NO: 1610. In some embodiments, the antisense strand comprises the nucleotide sequence SEQ ID NO: 2216, and the sense strand comprises the nucleotide sequence SEQ ID NO: 1610. In some embodiments, the antisense strand consists of the nucleotide sequence SEQ ID NO: 2216, and the sense strand consists of the nucleotide sequence SEQ ID NO: 1610.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2217, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1611. In some embodiments, the antisense strand comprises a nucleotide sequence differing by no more than 4 nucleotides (for example, 1, 2, 3, or 4 nucleotides) from SEQ ID NO: 2217, and the sense strand comprises a nucleotide sequence differing by no more than 4 nucleotides (for example, 1, 2, 3, or 4 nucleotides) from SEQ ID NO: 1611. In some embodiments, the antisense strand comprises the nucleotide sequence SEQ ID NO: 2217, and the sense strand comprises the nucleotide sequence SEQ ID NO: 1611. In some embodiments, the antisense strand consists of the nucleotide sequence SEQ ID NO: 2217, and the sense strand consists of the nucleotide sequence SEQ ID NO: 1611.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2218, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1612. In some embodiments, the antisense strand comprises a nucleotide sequence differing by no more than 4 nucleotides (for example, 1, 2, 3, or 4 nucleotides) from SEQ ID NO: 2218, and the sense strand comprises a nucleotide sequence differing by no more than 4 nucleotides (for example, 1, 2, 3, or 4 nucleotides) from SEQ ID NO: 1612. In some embodiments, the antisense strand comprises the nucleotide sequence SEQ ID NO: 2218, and the sense strand comprises the nucleotide sequence SEQ ID NO: 1612. In some embodiments, the antisense strand consists of the nucleotide sequence SEQ ID NO: 2218, and the sense strand consists of the nucleotide sequence SEQ ID NO: 1612.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2232, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1626. In some embodiments, the antisense strand comprises a nucleotide sequence differing by no more than 4 nucleotides (for example, 1, 2, 3, or 4 nucleotides) from SEQ ID NO: 2232, and the sense strand comprises a nucleotide sequence differing by no more than 4 nucleotides (for example, 1, 2, 3, or 4 nucleotides) from SEQ ID NO: 1626. In some embodiments, the antisense strand comprises the nucleotide sequence SEQ ID NO: 2232, and the sense strand comprises the nucleotide sequence SEQ ID NO: 1626. In some embodiments, the antisense strand consists of the nucleotide sequence SEQ ID NO: 2232, and the sense strand consists of the nucleotide sequence SEQ ID NO: 1626.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2235, and the sense strand comprises a nucleotide sequence comprising at least 15 more than 4 nucleotides (for example, 1, 2, 3, or 4 nucleotides) from SEQ ID NO: 1629. In some embodiments, the antisense strand comprises a nucleotide sequence differing by no more than 4 nucleotides (for example, 1, 2, 3, or 4 nucleotides) from SEQ ID NO: 2235, and the sense strand comprises a nucleotide sequence differing by no more than 4 nucleotides (for example, 1, 2, 3, or 4 nucleotides) from SEQ ID NO: 1629. In some embodiments, the antisense strand comprises the nucleotide sequence SEQ ID NO: 2235, and the sense strand comprises the nucleotide sequence SEQ ID NO: 1629. In some embodiments, the antisense strand consists of the nucleotide sequence SEQ ID NO: 2235, and the sense strand consists of the nucleotide sequence SEQ ID NO: 1629.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2236, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1630. In some embodiments, the antisense strand comprises a nucleotide sequence differing by no more than 4 nucleotides (for example, 1, 2, 3, or 4 nucleotides) from SEQ ID NO: 2236, and the sense strand comprises a nucleotide sequence differing by no more than 4 nucleotides (for example, 1, 2, 3, or 4 nucleotides) from SEQ ID NO: 1630. In some embodiments, the antisense strand comprises the nucleotide sequence SEQ ID NO: 2236, and the sense strand comprises the nucleotide sequence SEQ ID NO: 1630. In some embodiments, the antisense strand consists of the nucleotide sequence SEQ ID NO: 2236, and the sense strand consists of the nucleotide sequence SEQ ID NO: 1630.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2251, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1645. In some embodiments, the antisense strand comprises a nucleotide sequence differing by no more than 4 nucleotides (for example, 1, 2, 3, or 4 nucleotides) from SEQ ID NO: 2251, and the sense strand comprises a nucleotide sequence differing by no more than 4 nucleotides (for example, 1, 2, 3, or 4 nucleotides) from SEQ ID NO: 1645. In some embodiments, the antisense strand comprises the nucleotide sequence SEQ ID NO: 2251, and the sense strand comprises the nucleotide sequence SEQ ID NO: 1645. In some embodiments, the antisense strand consists of the nucleotide sequence SEQ ID NO: 2251, and the sense strand consists of the nucleotide sequence SEQ ID NO: 1645.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2260, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1654. In some embodiments, the antisense strand comprises a nucleotide sequence differing by no more than 4 nucleotides (for example, 1, 2, 3, or 4 nucleotides) from SEQ ID NO: 2260, and the sense strand comprises a nucleotide sequence differing by no more than 4 nucleotides (for example, 1, 2, 3, or 4 nucleotides) from SEQ ID NO: 1654. In some embodiments, the antisense strand comprises the nucleotide sequence SEQ ID NO: 2260, and the sense strand comprises the nucleotide sequence SEQ ID NO: 1654. In some embodiments, the antisense strand consists of the nucleotide sequence SEQ ID NO: 2260, and the sense strand consists of the nucleotide sequence SEQ ID NO: 1654.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2261, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1655. In some embodiments, the antisense strand comprises a nucleotide sequence differing by no more than 4 nucleotides (for example, 1, 2, 3, or 4 nucleotides) from SEQ ID NO: 2261, and the sense strand comprises a nucleotide sequence differing by no more than 4 nucleotides (for example, 1, 2, 3, or 4 nucleotides) from SEQ ID NO: 1655. In some embodiments, the antisense strand comprises the nucleotide sequence SEQ ID NO: 2261, and the sense strand comprises the nucleotide sequence SEQ ID NO: 1655. In some embodiments, the antisense strand consists of the nucleotide sequence SEQ ID NO: 2261, and the sense strand consists of the nucleotide sequence SEQ ID NO: 1655.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2267, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1661. In some embodiments, the antisense strand comprises a nucleotide sequence differing by no more than 4 nucleotides (for example, 1, 2, 3, or 4 nucleotides) from SEQ ID NO: 2267, and the sense strand comprises a nucleotide sequence differing by no more than 4 nucleotides (for example, 1, 2, 3, or 4 nucleotides) from SEQ ID NO: 1661. In some embodiments, the antisense strand comprises the nucleotide sequence SEQ ID NO: 2267, and the sense strand comprises the nucleotide sequence SEQ ID NO: 1661. In some embodiments, the antisense strand consists of the nucleotide sequence SEQ ID NO: 2267, and the sense strand consists of the nucleotide sequence SEQ ID NO: 1661.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2268, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1662. In some embodiments, the antisense strand comprises a nucleotide sequence differing by no more than 4 nucleotides (for example, 1, 2, 3, or 4 nucleotides) from SEQ ID NO: 2268, and the sense strand comprises a nucleotide sequence differing by no more than 4 nucleotides (for example, 1, 2, 3, or 4 nucleotides) from SEQ ID NO: 1662. In some embodiments, the antisense strand comprises the nucleotide sequence SEQ ID NO: 2268, and the sense strand comprises the nucleotide sequence SEQ ID NO: 1662. In some embodiments, the antisense strand consists of the nucleotide sequence SEQ ID NO: 2268, and the sense strand consists of the nucleotide sequence SEQ ID NO: 1662.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2269, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1663. In some embodiments, the antisense strand comprises a nucleotide sequence differing by no more than 4 nucleotides (for example, 1, 2, 3, or 4 nucleotides) from SEQ ID NO: 2269, and the sense strand comprises a nucleotide sequence differing by no more than 4 nucleotides (for example, 1, 2, 3, or 4 nucleotides) from SEQ ID NO: 1663. In some embodiments, the antisense strand comprises the nucleotide sequence SEQ ID NO: 2269, and the sense strand comprises the nucleotide sequence SEQ ID NO: 1663. In some embodiments, the antisense strand consists of the nucleotide sequence SEQ ID NO: 2269, and the sense strand consists of the nucleotide sequence SEQ ID NO: 1663.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2270, and the sense strand comprises a nucleotide sequence comprising at least 15 more than 4 nucleotides (for example, 1, 2, 3, or 4 nucleotides) from SEQ ID NO: 1664. In some embodiments, the antisense strand comprises a nucleotide sequence differing by no more than 4 nucleotides (for example, 1, 2, 3, or 4 nucleotides) from SEQ ID NO: 2270, and the sense strand comprises a nucleotide sequence differing by no more than 4 nucleotides (for example, 1, 2, 3, or 4 nucleotides) from SEQ ID NO: 1664. In some embodiments, the antisense strand comprises the nucleotide sequence SEQ ID NO: 2270, and the sense strand comprises the nucleotide sequence SEQ ID NO: 1664. In some embodiments, the antisense strand consists of the nucleotide sequence SEQ ID NO: 2270, and the sense strand consists of the nucleotide sequence SEQ ID NO: 1664.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2271, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1665. In some embodiments, the antisense strand comprises a nucleotide sequence differing by no more than 4 nucleotides (for example, 1, 2, 3, or 4 nucleotides) from SEQ ID NO: 2271, and the sense strand comprises a nucleotide sequence differing by no more than 4 nucleotides (for example, 1, 2, 3, or 4 nucleotides) from SEQ ID NO: 1665. In some embodiments, the antisense strand comprises the nucleotide sequence SEQ ID NO: 2271, and the sense strand comprises the nucleotide sequence SEQ ID NO: 1665. In some embodiments, the antisense strand consists of the nucleotide sequence SEQ ID NO: 2271, and the sense strand consists of the nucleotide sequence SEQ ID NO: 1665.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2276, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1670. In some embodiments, the antisense strand comprises a nucleotide sequence differing by no more than 4 nucleotides (for example, 1, 2, 3, or 4 nucleotides) from SEQ ID NO: 2276, and the sense strand comprises a nucleotide sequence differing by no more than 4 nucleotides (for example, 1, 2, 3, or 4 nucleotides) from SEQ ID NO: 1670. In some embodiments, the antisense strand comprises the nucleotide sequence SEQ ID NO: 2276, and the sense strand comprises the nucleotide sequence SEQ ID NO: 1670. In some embodiments, the antisense strand consists of the nucleotide sequence SEQ ID NO: 2276, and the sense strand consists of the nucleotide sequence SEQ ID NO: 1670.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2277, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1671. In some embodiments, the antisense strand comprises a nucleotide sequence differing by no more than 4 nucleotides (for example, 1, 2, 3, or 4 nucleotides) from SEQ ID NO: 2277, and the sense strand comprises a nucleotide sequence differing by no more than 4 nucleotides (for example, 1, 2, 3, or 4 nucleotides) from SEQ ID NO: 1671. In some embodiments, the antisense strand comprises the nucleotide sequence SEQ ID NO: 2277, and the sense strand comprises the nucleotide sequence SEQ ID NO: 1671. In some embodiments, the antisense strand consists of the nucleotide sequence SEQ ID NO: 2277, and the sense strand consists of the nucleotide sequence SEQ ID NO: 1671.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2278, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1672. In some embodiments, the antisense strand comprises a nucleotide sequence differing by no more than 4 nucleotides (for example, 1, 2, 3, or 4 nucleotides) from SEQ ID NO: 2278, and the sense strand comprises a nucleotide sequence differing by no more than 4 nucleotides (for example, 1, 2, 3, or 4 nucleotides) from SEQ ID NO: 1672. In some embodiments, the antisense strand comprises the nucleotide sequence SEQ ID NO: 2278, and the sense strand comprises the nucleotide sequence SEQ ID NO: 1672. In some embodiments, the antisense strand consists of the nucleotide sequence SEQ ID NO: 2278, and the sense strand consists of the nucleotide sequence SEQ ID NO: 1672.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2279, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1673. In some embodiments, the antisense strand comprises a nucleotide sequence differing by no more than 4 nucleotides (for example, 1, 2, 3, or 4 nucleotides) from SEQ ID NO: 2279, and the sense strand comprises a nucleotide sequence differing by no more than 4 nucleotides (for example, 1, 2, 3, or 4 nucleotides) from SEQ ID NO: 1673. In some embodiments, the antisense strand comprises the nucleotide sequence SEQ ID NO: 2279, and the sense strand comprises the nucleotide sequence SEQ ID NO: 1673. In some embodiments, the antisense strand consists of the nucleotide sequence SEQ ID NO: 2279, and the sense strand consists of the nucleotide sequence SEQ ID NO: 1673.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2280, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1674. In some embodiments, the antisense strand comprises a nucleotide sequence differing by no more than 4 nucleotides (for example, 1, 2, 3, or 4 nucleotides) from SEQ ID NO: 2280, and the sense strand comprises a nucleotide sequence differing by no more than 4 nucleotides (for example, 1, 2, 3, or 4 nucleotides) from SEQ ID NO: 1674. In some embodiments, the antisense strand comprises the nucleotide sequence SEQ ID NO: 2280, and the sense strand comprises the nucleotide sequence SEQ ID NO: 1674. In some embodiments, the antisense strand consists of the nucleotide sequence SEQ ID NO: 2280, and the sense strand consists of the nucleotide sequence SEQ ID NO: 1674.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2281, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1675. In some embodiments, the antisense strand comprises a nucleotide sequence differing by no more than 4 nucleotides (for example, 1, 2, 3, or 4 nucleotides) from SEQ ID NO: 2281, and the sense strand comprises a nucleotide sequence differing by no more than 4 nucleotides (for example, 1, 2, 3, or 4 nucleotides) from SEQ ID NO: 1675. In some embodiments, the antisense strand comprises the nucleotide sequence SEQ ID NO: 2281, and the sense strand comprises the nucleotide sequence SEQ ID NO: 1675. In some embodiments, the antisense strand consists of the nucleotide sequence SEQ ID NO: 2281, and the sense strand consists of the nucleotide sequence SEQ ID NO: 1675.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2283, and the sense strand comprises a nucleotide sequence comprising at least 15 more than 4 nucleotides (for example, 1, 2, 3, or 4 nucleotides) from SEQ ID NO: 1677. In some embodiments, the antisense strand comprises a nucleotide sequence differing by no more than 4 nucleotides (for example, 1, 2, 3, or 4 nucleotides) from SEQ ID NO: 2283, and the sense strand comprises a nucleotide sequence differing by no more than 4 nucleotides (for example, 1, 2, 3, or 4 nucleotides) from SEQ ID NO: 1677. In some embodiments, the antisense strand comprises the nucleotide sequence SEQ ID NO: 2283, and the sense strand comprises the nucleotide sequence SEQ ID NO: 1677. In some embodiments, the antisense strand consists of the nucleotide sequence SEQ ID NO: 2283, and the sense strand consists of the nucleotide sequence SEQ ID NO: 1677.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2284, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1678. In some embodiments, the antisense strand comprises a nucleotide sequence differing by no more than 4 nucleotides (for example, 1, 2, 3, or 4 nucleotides) from SEQ ID NO: 2284, and the sense strand comprises a nucleotide sequence differing by no more than 4 nucleotides (for example, 1, 2, 3, or 4 nucleotides) from SEQ ID NO: 1678. In some embodiments, the antisense strand comprises the nucleotide sequence SEQ ID NO: 2284, and the sense strand comprises the nucleotide sequence SEQ ID NO: 1678. In some embodiments, the antisense strand consists of the nucleotide sequence SEQ ID NO: 2284, and the sense strand consists of the nucleotide sequence SEQ ID NO: 1678.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2292, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1686. In some embodiments, the antisense strand comprises a nucleotide sequence differing by no more than 4 nucleotides (for example, 1, 2, 3, or 4 nucleotides) from SEQ ID NO: 2292, and the sense strand comprises a nucleotide sequence differing by no more than 4 nucleotides (for example, 1, 2, 3, or 4 nucleotides) from SEQ ID NO: 1686. In some embodiments, the antisense strand comprises the nucleotide sequence SEQ ID NO: 2292, and the sense strand comprises the nucleotide sequence SEQ ID NO: 1686. In some embodiments, the antisense strand consists of the nucleotide sequence SEQ ID NO: 2292, and the sense strand consists of the nucleotide sequence SEQ ID NO: 1686.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2293, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1687. In some embodiments, the antisense strand comprises a nucleotide sequence differing by no more than 4 nucleotides (for example, 1, 2, 3, or 4 nucleotides) from SEQ ID NO: 2293, and the sense strand comprises a nucleotide sequence differing by no more than 4 nucleotides (for example, 1, 2, 3, or 4 nucleotides) from SEQ ID NO: 1687. In some embodiments, the antisense strand comprises the nucleotide sequence SEQ ID NO: 2293, and the sense strand comprises the nucleotide sequence SEQ ID NO: 1687. In some embodiments, the antisense strand consists of the nucleotide sequence SEQ ID NO: 2293, and the sense strand consists of the nucleotide sequence SEQ ID NO: 1687.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2299, and the sense strand comprises a nucleotide sequence comprising at least 15 contiguous nucleotides (for example, 15, 16, 17, 18, or 19 contiguous nucleotides)

differing by no more than 4 nucleotides (for example, 1, 2, 3, or 4 nucleotides) from SEQ ID NO: 1693. In some embodiments, the antisense strand comprises a nucleotide sequence differing by no more than 4 nucleotides (for example, 1, 2, 3, or 4 nucleotides) from SEQ ID NO: 2299, and the sense strand comprises a nucleotide sequence differing by no more than 4 nucleotides (for example, 1, 2, 3, or 4 nucleotides) from SEQ ID NO: 1693. In some embodiments, the antisense strand comprises the nucleotide sequence SEQ ID NO: 2299, and the sense strand comprises the nucleotide sequence SEQ ID NO: 1693. In some embodiments, the antisense strand consists of the nucleotide sequence SEQ ID NO: 2299, and the sense strand consists of the nucleotide sequence SEQ ID NO: 1693.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2300, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1694. In some embodiments, the antisense strand comprises a nucleotide sequence differing by no more than 4 nucleotides (for example, 1, 2, 3, or 4 nucleotides) from SEQ ID NO: 2300, and the sense strand comprises a nucleotide sequence differing by no more than 4 nucleotides (for example, 1, 2, 3, or 4 nucleotides) from SEQ ID NO: 1694. In some embodiments, the antisense strand comprises the nucleotide sequence SEQ ID NO: 2300, and the sense strand comprises the nucleotide sequence SEQ ID NO: 1694. In some embodiments, the antisense strand consists of the nucleotide sequence SEQ ID NO: 2300, and the sense strand consists of the nucleotide sequence SEQ ID NO: 1694.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2305, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1699. In some embodiments, the antisense strand comprises a nucleotide sequence differing by no more than 4 nucleotides (for example, 1, 2, 3, or 4 nucleotides) from SEQ ID NO: 2305, and the sense strand comprises a nucleotide sequence differing by no more than 4 nucleotides (for example, 1, 2, 3, or 4 nucleotides) from SEQ ID NO: 1699. In some embodiments, the antisense strand comprises the nucleotide sequence SEQ ID NO: 2305, and the sense strand comprises the nucleotide sequence SEQ ID NO: 1699. In some embodiments, the antisense strand consists of the nucleotide sequence SEQ ID NO: 2305, and the sense strand consists of the nucleotide sequence SEQ ID NO: 1699.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2306, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1700. In some embodiments, the antisense strand comprises a nucleotide sequence differing by no more than 4 nucleotides (for example, 1, 2, 3, or 4 nucleotides) from SEQ ID NO: 2306, and the sense strand comprises a nucleotide sequence differing by no more than 4 nucleotides (for example, 1, 2, 3, or 4 nucleotides) from SEQ ID NO: 1700. In some embodiments, the antisense strand comprises the nucleotide sequence SEQ ID NO: 2306, and the sense strand comprises the nucleotide sequence SEQ ID NO: 1700. In some embodiments, the antisense strand consists of the nucleotide sequence SEQ ID NO: 2306, and the sense strand consists of the nucleotide sequence SEQ ID NO: 1700.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2307, and the sense strand comprises a nucleotide sequence comprising at least 15 more than 4 nucleotides (for example, 1, 2, 3, or 4 nucleotides) from SEQ ID NO: 1701. In some embodiments, the antisense strand comprises a nucleotide sequence differing by no more than 4 nucleotides (for example, 1, 2, 3, or 4 nucleotides) from SEQ ID NO: 2307, and the sense strand comprises a nucleotide sequence differing by no more than 4 nucleotides (for example, 1, 2, 3, or 4 nucleotides) from SEQ ID NO: 1701. In some embodiments, the antisense strand comprises the nucleotide sequence SEQ ID NO: 2307, and the sense strand comprises the nucleotide sequence SEQ ID NO: 1701. In some embodiments, the antisense strand consists of the nucleotide sequence SEQ ID NO: 2307, and the sense strand consists of the nucleotide sequence SEQ ID NO: 1701.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2308, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1702. In some embodiments, the antisense strand comprises a nucleotide sequence differing by no more than 4 nucleotides (for example, 1, 2, 3, or 4 nucleotides) from SEQ ID NO: 2308, and the sense strand comprises a nucleotide sequence differing by no more than 4 nucleotides (for example, 1, 2, 3, or 4 nucleotides) from SEQ ID NO: 1702. In some embodiments, the antisense strand comprises the nucleotide sequence SEQ ID NO: 2308, and the sense strand comprises the nucleotide sequence SEQ ID NO: 1702. In some embodiments, the antisense strand consists of the nucleotide sequence SEQ ID NO: 2308, and the sense strand consists of the nucleotide sequence SEQ ID NO: 1702.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2317, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1711. In some embodiments, the antisense strand comprises a nucleotide sequence differing by no more than 4 nucleotides (for example, 1, 2, 3, or 4 nucleotides) from SEQ ID NO: 2317, and the sense strand comprises a nucleotide sequence differing by no more than 4 nucleotides (for example, 1, 2, 3, or 4 nucleotides) from SEQ ID NO: 1711. In some embodiments, the antisense strand comprises the nucleotide sequence SEQ ID NO: 2317, and the sense strand comprises the nucleotide sequence SEQ ID NO: 1711. In some embodiments, the antisense strand consists of the nucleotide sequence SEQ ID NO: 2317, and the sense strand consists of the nucleotide sequence SEQ ID NO: 1711.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2318, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1712. In some embodiments, the antisense strand comprises a nucleotide sequence differing by no more than 4 nucleotides (for example, 1, 2, 3, or 4 nucleotides) from SEQ ID NO: 2318, and the sense strand comprises a nucleotide sequence differing by no more than 4 nucleotides (for example, 1, 2, 3, or 4 nucleotides) from SEQ ID NO: 1712. In some embodiments, the antisense strand comprises the nucleotide sequence SEQ ID NO: 2318, and the sense strand comprises the nucleotide sequence SEQ ID NO: 1712. In some embodiments, the antisense strand consists of the nucleotide sequence SEQ ID NO: 2318, and the sense strand consists of the nucleotide sequence SEQ ID NO: 1712.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2319, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1713. In some embodiments, the antisense strand comprises a nucleotide sequence differing by no more than 4 nucleotides (for example, 1, 2, 3, or 4 nucleotides) from SEQ ID NO: 2319, and the sense strand comprises a nucleotide sequence differing by no more than 4 nucleotides (for example, 1, 2, 3, or 4 nucleotides) from SEQ ID NO: 1713. In some embodiments, the antisense strand comprises the nucleotide sequence SEQ ID NO: 2319, and the sense strand comprises the nucleotide sequence SEQ ID NO: 1713. In some embodiments, the antisense strand consists of the nucleotide sequence SEQ ID NO: 2319, and the sense strand consists of the nucleotide sequence SEQ ID NO: 1713.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2321, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1715. In some embodiments, the antisense strand comprises a nucleotide sequence differing by no more than 4 nucleotides (for example, 1, 2, 3, or 4 nucleotides) from SEQ ID NO: 2321, and the sense strand comprises a nucleotide sequence differing by no more than 4 nucleotides (for example, 1, 2, 3, or 4 nucleotides) from SEQ ID NO: 1715. In some embodiments, the antisense strand comprises the nucleotide sequence SEQ ID NO: 2321, and the sense strand comprises the nucleotide sequence SEQ ID NO: 1715. In some embodiments, the antisense strand consists of the nucleotide sequence SEQ ID NO: 2321, and the sense strand consists of the nucleotide sequence SEQ ID NO: 1715.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2324, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1718. In some embodiments, the antisense strand comprises a nucleotide sequence differing by no more than 4 nucleotides (for example, 1, 2, 3, or 4 nucleotides) from SEQ ID NO: 2324, and the sense strand comprises a nucleotide sequence differing by no more than 4 nucleotides (for example, 1, 2, 3, or 4 nucleotides) from SEQ ID NO: 1718. In some embodiments, the antisense strand comprises the nucleotide sequence SEQ ID NO: 2324, and the sense strand comprises the nucleotide sequence SEQ ID NO: 1718. In some embodiments, the antisense strand consists of the nucleotide sequence SEQ ID NO: 2324, and the sense strand consists of the nucleotide sequence SEQ ID NO: 1718.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2325, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1719. In some embodiments, the antisense strand comprises a nucleotide sequence differing by no more than 4 nucleotides (for example, 1, 2, 3, or 4 nucleotides) from SEQ ID NO: 2325, and the sense strand comprises a nucleotide sequence differing by no more than 4 nucleotides (for example, 1, 2, 3, or 4 nucleotides) from SEQ ID NO: 1719. In some embodiments, the antisense strand comprises the nucleotide sequence SEQ ID NO: 2325, and the sense strand comprises the nucleotide sequence SEQ ID NO: 1719. In some embodiments, the antisense strand consists of the nucleotide sequence SEQ ID NO: 2325, and the sense strand consists of the nucleotide sequence SEQ ID NO: 1719.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2326, and the sense strand comprises a nucleotide sequence comprising at least 15 more than 4 nucleotides (for example, 1, 2, 3, or 4 nucleotides) from SEQ ID NO: 1720. In some embodiments, the antisense strand comprises a nucleotide sequence differing by no more than 4 nucleotides (for example, 1, 2, 3, or 4 nucleotides) from SEQ ID NO: 2326, and the sense strand comprises a nucleotide sequence differing by no more than 4 nucleotides (for example, 1, 2, 3, or 4 nucleotides) from SEQ ID NO: 1720. In some embodiments, the antisense strand comprises the nucleotide sequence SEQ ID NO: 2326, and the sense strand comprises the nucleotide sequence SEQ ID NO: 1720. In some embodiments, the antisense strand consists of the nucleotide sequence SEQ ID NO: 2326, and the sense strand consists of the nucleotide sequence SEQ ID NO: 1720.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2330, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1724. In some embodiments, the antisense strand comprises a nucleotide sequence differing by no more than 4 nucleotides (for example, 1, 2, 3, or 4 nucleotides) from SEQ ID NO: 2330, and the sense strand comprises a nucleotide sequence differing by no more than 4 nucleotides (for example, 1, 2, 3, or 4 nucleotides) from SEQ ID NO: 1724. In some embodiments, the antisense strand comprises the nucleotide sequence SEQ ID NO: 2330, and the sense strand comprises the nucleotide sequence SEQ ID NO: 1724. In some embodiments, the antisense strand consists of the nucleotide sequence SEQ ID NO: 2330, and the sense strand consists of the nucleotide sequence SEQ ID NO: 1724.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2331, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1725. In some embodiments, the antisense strand comprises a nucleotide sequence differing by no more than 4 nucleotides (for example, 1, 2, 3, or 4 nucleotides) from SEQ ID NO: 2331, and the sense strand comprises a nucleotide sequence differing by no more than 4 nucleotides (for example, 1, 2, 3, or 4 nucleotides) from SEQ ID NO: 1725. In some embodiments, the antisense strand comprises the nucleotide sequence SEQ ID NO: 2331, and the sense strand comprises the nucleotide sequence SEQ ID NO: 1725. In some embodiments, the antisense strand consists of the nucleotide sequence SEQ ID NO: 2331, and the sense strand consists of the nucleotide sequence SEQ ID NO: 1725.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2333, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1727. In some embodiments, the antisense strand comprises a nucleotide sequence differing by no more than 4 nucleotides (for example, 1, 2, 3, or 4 nucleotides) from SEQ ID NO: 2333, and the sense strand comprises a nucleotide sequence differing by no more than 4 nucleotides (for example, 1, 2, 3, or 4 nucleotides) from SEQ ID NO: 1727. In some embodiments, the antisense strand comprises the nucleotide sequence SEQ ID NO: 2333, and the sense strand comprises the nucleotide sequence SEQ ID NO: 1727. In some embodiments, the antisense strand consists of the nucleotide sequence SEQ ID NO: 2333, and the sense strand consists of the nucleotide sequence SEQ ID NO: 1727.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2334, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1728. In some embodiments, the antisense strand comprises a nucleotide sequence differing by no more than 4 nucleotides (for example, 1, 2, 3, or 4 nucleotides) from SEQ ID NO: 2334, and the sense strand comprises a nucleotide sequence differing by no more than 4 nucleotides (for example, 1, 2, 3, or 4 nucleotides) from SEQ ID NO: 1728. In some embodiments, the antisense strand comprises the nucleotide sequence SEQ ID NO: 2334, and the sense strand comprises the nucleotide sequence SEQ ID NO: 1728. In some embodiments, the antisense strand consists of the nucleotide sequence SEQ ID NO: 2334, and the sense strand consists of the nucleotide sequence SEQ ID NO: 1728.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2336, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1730. In some embodiments, the antisense strand comprises a nucleotide sequence differing by no more than 4 nucleotides (for example, 1, 2, 3, or 4 nucleotides) from SEQ ID NO: 2336, and the sense strand comprises a nucleotide sequence differing by no more than 4 nucleotides (for example, 1, 2, 3, or 4 nucleotides) from SEQ ID NO: 1730. In some embodiments, the antisense strand comprises the nucleotide sequence SEQ ID NO: 2336, and the sense strand comprises the nucleotide sequence SEQ ID NO: 1730. In some embodiments, the antisense strand consists of the nucleotide sequence SEQ ID NO: 2336, and the sense strand consists of the nucleotide sequence SEQ ID NO: 1730.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2338, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1732. In some embodiments, the antisense strand comprises a nucleotide sequence differing by no more than 4 nucleotides (for example, 1, 2, 3, or 4 nucleotides) from SEQ ID NO: 2338, and the sense strand comprises a nucleotide sequence differing by no more than 4 nucleotides (for example, 1, 2, 3, or 4 nucleotides) from SEQ ID NO: 1732. In some embodiments, the antisense strand comprises the nucleotide sequence SEQ ID NO: 2338, and the sense strand comprises the nucleotide sequence SEQ ID NO: 1732. In some embodiments, the antisense strand consists of the nucleotide sequence SEQ ID NO: 2338, and the sense strand consists of the nucleotide sequence SEQ ID NO: 1732.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2339, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1733. In some embodiments, the antisense strand comprises a nucleotide sequence differing by no more than 4 nucleotides (for example, 1, 2, 3, or 4 nucleotides) from SEQ ID NO: 2339, and the sense strand comprises a nucleotide sequence differing by no more than 4 nucleotides (for example, 1, 2, 3, or 4 nucleotides) from SEQ ID NO: 1733. In some embodiments, the antisense strand comprises the nucleotide sequence SEQ ID NO: 2339, and the sense strand comprises the nucleotide sequence SEQ ID NO: 1733. In some embodiments, the antisense strand consists of the nucleotide sequence SEQ ID NO: 2339, and the sense strand consists of the nucleotide sequence SEQ ID NO: 1733.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2340, and the sense strand comprises a nucleotide sequence comprising at least 15 more than 4 nucleotides (for example, 1, 2, 3, or 4 nucleotides) from SEQ ID NO: 1734. In some embodiments, the antisense strand comprises a nucleotide sequence differing by no more than 4 nucleotides (for example, 1, 2, 3, or 4 nucleotides) from SEQ ID NO: 2340, and the sense strand comprises a nucleotide sequence differing by no more than 4 nucleotides (for example, 1, 2, 3, or 4 nucleotides) from SEQ ID NO: 1734. In some embodiments, the antisense strand comprises the nucleotide sequence SEQ ID NO: 2340, and the sense strand comprises the nucleotide sequence SEQ ID NO: 1734. In some embodiments, the antisense strand consists of the nucleotide sequence SEQ ID NO: 2340, and the sense strand consists of the nucleotide sequence SEQ ID NO: 1734.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2341, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1735. In some embodiments, the antisense strand comprises a nucleotide sequence differing by no more than 4 nucleotides (for example, 1, 2, 3, or 4 nucleotides) from SEQ ID NO: 2341, and the sense strand comprises a nucleotide sequence differing by no more than 4 nucleotides (for example, 1, 2, 3, or 4 nucleotides) from SEQ ID NO: 1735. In some embodiments, the antisense strand comprises the nucleotide sequence SEQ ID NO: 2341, and the sense strand comprises the nucleotide sequence SEQ ID NO: 1735. In some embodiments, the antisense strand consists of the nucleotide sequence SEQ ID NO: 2341, and the sense strand consists of the nucleotide sequence SEQ ID NO: 1735.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2345, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1739. In some embodiments, the antisense strand comprises a nucleotide sequence differing by no more than 4 nucleotides (for example, 1, 2, 3, or 4 nucleotides) from SEQ ID NO: 2345, and the sense strand comprises a nucleotide sequence differing by no more than 4 nucleotides (for example, 1, 2, 3, or 4 nucleotides) from SEQ ID NO: 1739. In some embodiments, the antisense strand comprises the nucleotide sequence SEQ ID NO: 2345, and the sense strand comprises the nucleotide sequence SEQ ID NO: 1739. In some embodiments, the antisense strand consists of the nucleotide sequence SEQ ID NO: 2345, and the sense strand consists of the nucleotide sequence SEQ ID NO: 1739.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2346, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1740. In some embodiments, the antisense strand comprises a nucleotide sequence differing by no more than 4 nucleotides (for example, 1, 2, 3, or 4 nucleotides) from SEQ ID NO: 2346, and the sense strand comprises a nucleotide sequence differing by no more than 4 nucleotides (for example, 1, 2, 3, or 4 nucleotides) from SEQ ID NO: 1740. In some embodiments, the antisense strand comprises the nucleotide sequence SEQ ID NO: 2346, and the sense strand comprises the nucleotide sequence SEQ ID NO: 1740. In some embodiments, the antisense strand consists of the nucleotide sequence SEQ ID NO: 2346, and the sense strand consists of the nucleotide sequence SEQ ID NO: 1740.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2349, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1743. In some embodiments, the antisense strand comprises a nucleotide sequence differing by no more than 4 nucleotides (for example, 1, 2, 3, or 4 nucleotides) from SEQ ID NO: 2349, and the sense strand comprises a nucleotide sequence differing by no more than 4 nucleotides (for example, 1, 2, 3, or 4 nucleotides) from SEQ ID NO: 1743. In some embodiments, the antisense strand comprises the nucleotide sequence SEQ ID NO: 2349, and the sense strand comprises the nucleotide sequence SEQ ID NO: 1743. In some embodiments, the antisense strand consists of the nucleotide sequence SEQ ID NO: 2349, and the sense strand consists of the nucleotide sequence SEQ ID NO: 1743.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2350, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1744. In some embodiments, the antisense strand comprises a nucleotide sequence differing by no more than 4 nucleotides (for example, 1, 2, 3, or 4 nucleotides) from SEQ ID NO: 2350, and the sense strand comprises a nucleotide sequence differing by no more than 4 nucleotides (for example, 1, 2, 3, or 4 nucleotides) from SEQ ID NO: 1744. In some embodiments, the antisense strand comprises the nucleotide sequence SEQ ID NO: 2350, and the sense strand comprises the nucleotide sequence SEQ ID NO: 1744. In some embodiments, the antisense strand consists of the nucleotide sequence SEQ ID NO: 2350, and the sense strand consists of the nucleotide sequence SEQ ID NO: 1744.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2353, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1747. In some embodiments, the antisense strand comprises a nucleotide sequence differing by no more than 4 nucleotides (for example, 1, 2, 3, or 4 nucleotides) from SEQ ID NO: 2353, and the sense strand comprises a nucleotide sequence differing by no more than 4 nucleotides (for example, 1, 2, 3, or 4 nucleotides) from SEQ ID NO: 1747. In some embodiments, the antisense strand comprises the nucleotide sequence SEQ ID NO: 2353, and the sense strand comprises the nucleotide sequence SEQ ID NO: 1747. In some embodiments, the antisense strand consists of the nucleotide sequence SEQ ID NO: 2353, and the sense strand consists of the nucleotide sequence SEQ ID NO: 1747.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2354, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1748. In some embodiments, the antisense strand comprises a nucleotide sequence differing by no more than 4 nucleotides (for example, 1, 2, 3, or 4 nucleotides) from SEQ ID NO: 2354, and the sense strand comprises a nucleotide sequence differing by no more than 4 nucleotides (for example, 1, 2, 3, or 4 nucleotides) from SEQ ID NO: 1748. In some embodiments, the antisense strand comprises the nucleotide sequence SEQ ID NO: 2354, and the sense strand comprises the nucleotide sequence SEQ ID NO: 1748. In some embodiments, the antisense strand consists of the nucleotide sequence SEQ ID NO: 2354, and the sense strand consists of the nucleotide sequence SEQ ID NO: 1748.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2355, and the sense strand comprises a nucleotide sequence comprising at least 15 more than 4 nucleotides (for example, 1, 2, 3, or 4 nucleotides) from SEQ ID NO: 1749. In some embodiments, the antisense strand comprises a nucleotide sequence differing by no more than 4 nucleotides (for example, 1, 2, 3, or 4 nucleotides) from SEQ ID NO: 2355, and the sense strand comprises a nucleotide sequence differing by no more than 4 nucleotides (for example, 1, 2, 3, or 4 nucleotides) from SEQ ID NO: 1749. In some embodiments, the antisense strand comprises the nucleotide sequence SEQ ID NO: 2355, and the sense strand comprises the nucleotide sequence SEQ ID NO: 1749. In some embodiments, the antisense strand consists of the nucleotide sequence SEQ ID NO: 2355, and the sense strand consists of the nucleotide sequence SEQ ID NO: 1749.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2361, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1755. In some embodiments, the antisense strand comprises a nucleotide sequence differing by no more than 4 nucleotides (for example, 1, 2, 3, or 4 nucleotides) from SEQ ID NO: 2361, and the sense strand comprises a nucleotide sequence differing by no more than 4 nucleotides (for example, 1, 2, 3, or 4 nucleotides) from SEQ ID NO: 1755. In some embodiments, the antisense strand comprises the nucleotide sequence SEQ ID NO: 2361, and the sense strand comprises the nucleotide sequence SEQ ID NO: 1755. In some embodiments, the antisense strand consists of the nucleotide sequence SEQ ID NO: 2361, and the sense strand consists of the nucleotide sequence SEQ ID NO: 1755.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2362, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1756. In some embodiments, the antisense strand comprises a nucleotide sequence differing by no more than 4 nucleotides (for example, 1, 2, 3, or 4 nucleotides) from SEQ ID NO: 2362, and the sense strand comprises a nucleotide sequence differing by no more than 4 nucleotides (for example, 1, 2, 3, or 4 nucleotides) from SEQ ID NO: 1756. In some embodiments, the antisense strand comprises the nucleotide sequence SEQ ID NO: 2362, and the sense strand comprises the nucleotide sequence SEQ ID NO: 1756. In some embodiments, the antisense strand consists of the nucleotide sequence SEQ ID NO: 2362, and the sense strand consists of the nucleotide sequence SEQ ID NO: 1756.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2363, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1757. In some embodiments, the antisense strand comprises a nucleotide sequence differing by no more than 4 nucleotides (for example, 1, 2, 3, or 4 nucleotides) from SEQ ID NO: 2363, and the sense strand comprises a nucleotide sequence differing by no more than 4 nucleotides (for example, 1, 2, 3, or 4 nucleotides) from SEQ ID NO: 1757. In some embodiments, the antisense strand comprises the nucleotide sequence SEQ ID NO: 2363, and the sense strand comprises the nucleotide sequence SEQ ID NO: 1757. In some embodiments, the antisense strand consists of the nucleotide sequence SEQ ID NO: 2363, and the sense strand consists of the nucleotide sequence SEQ ID NO: 1757.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2367, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1761. In some embodiments, the antisense strand comprises a nucleotide sequence differing by no more than 4 nucleotides (for example, 1, 2, 3, or 4 nucleotides) from SEQ ID NO: 2367, and the sense strand comprises a nucleotide sequence differing by no more than 4 nucleotides (for example, 1, 2, 3, or 4 nucleotides) from SEQ ID NO: 1761. In some embodiments, the antisense strand comprises the nucleotide sequence SEQ ID NO: 2367, and the sense strand comprises the nucleotide sequence SEQ ID NO: 1761. In some embodiments, the antisense strand consists of the nucleotide sequence SEQ ID NO: 2367, and the sense strand consists of the nucleotide sequence SEQ ID NO: 1761.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2369, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1763. In some embodiments, the antisense strand comprises a nucleotide sequence differing by no more than 4 nucleotides (for example, 1, 2, 3, or 4 nucleotides) from SEQ ID NO: 2369, and the sense strand comprises a nucleotide sequence differing by no more than 4 nucleotides (for example, 1, 2, 3, or 4 nucleotides) from SEQ ID NO: 1763. In some embodiments, the antisense strand comprises the nucleotide sequence SEQ ID NO: 2369, and the sense strand comprises the nucleotide sequence SEQ ID NO: 1763. In some embodiments, the antisense strand consists of the nucleotide sequence SEQ ID NO: 2369, and the sense strand consists of the nucleotide sequence SEQ ID NO: 1763.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2371, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1765. In some embodiments, the antisense strand comprises a nucleotide sequence differing by no more than 4 nucleotides (for example, 1, 2, 3, or 4 nucleotides) from SEQ ID NO: 2371, and the sense strand comprises a nucleotide sequence differing by no more than 4 nucleotides (for example, 1, 2, 3, or 4 nucleotides) from SEQ ID NO: 1765. In some embodiments, the antisense strand comprises the nucleotide sequence SEQ ID NO: 2371, and the sense strand comprises the nucleotide sequence SEQ ID NO: 1765. In some embodiments, the antisense strand consists of the nucleotide sequence SEQ ID NO: 2371, and the sense strand consists of the nucleotide sequence SEQ ID NO: 1765.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2372, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1766. In some embodiments, the antisense strand comprises a nucleotide sequence differing by no more than 4 nucleotides (for example, 1, 2, 3, or 4 nucleotides) from SEQ ID NO: 2372, and the sense strand comprises a nucleotide sequence differing by no more than 4 nucleotides (for example, 1, 2, 3, or 4 nucleotides) from SEQ ID NO: 1766. In some embodiments, the antisense strand comprises the nucleotide sequence SEQ ID NO: 2372, and the sense strand comprises the nucleotide sequence SEQ ID NO: 1766. In some embodiments, the antisense strand consists of the nucleotide sequence SEQ ID NO: 2372, and the sense strand consists of the nucleotide sequence SEQ ID NO: 1766.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2373, and the sense strand comprises a nucleotide sequence comprising at least 15 more than 4 nucleotides (for example, 1, 2, 3, or 4 nucleotides) from SEQ ID NO: 1767. In some embodiments, the antisense strand comprises a nucleotide sequence differing by no more than 4 nucleotides (for example, 1, 2, 3, or 4 nucleotides) from SEQ ID NO: 2373, and the sense strand comprises a nucleotide sequence differing by no more than 4 nucleotides (for example, 1, 2, 3, or 4 nucleotides) from SEQ ID NO: 1767. In some embodiments, the antisense strand comprises the nucleotide sequence SEQ ID NO: 2373, and the sense strand comprises the nucleotide sequence SEQ ID NO: 1767. In some embodiments, the antisense strand consists of the nucleotide sequence SEQ ID NO: 2373, and the sense strand consists of the nucleotide sequence SEQ ID NO: 1767.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2380, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1774. In some embodiments, the antisense strand comprises a nucleotide sequence differing by no more than 4 nucleotides (for example, 1, 2, 3, or 4 nucleotides) from SEQ ID NO: 2380, and the sense strand comprises a nucleotide sequence differing by no more than 4 nucleotides (for example, 1, 2, 3, or 4 nucleotides) from SEQ ID NO: 1774. In some embodiments, the antisense strand comprises the nucleotide sequence SEQ ID NO: 2380, and the sense strand comprises the nucleotide sequence SEQ ID NO: 1774. In some embodiments, the antisense strand consists of the nucleotide sequence SEQ ID NO: 2380, and the sense strand consists of the nucleotide sequence SEQ ID NO: 1774.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2381, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1775. In some embodiments, the antisense strand comprises a nucleotide sequence differing by no more than 4 nucleotides (for example, 1, 2, 3, or 4 nucleotides) from SEQ ID NO: 2381, and the sense strand comprises a nucleotide sequence differing by no more than 4 nucleotides (for example, 1, 2, 3, or 4 nucleotides) from SEQ ID NO: 1775. In some embodiments, the antisense strand comprises the nucleotide sequence SEQ ID NO: 2381, and the sense strand comprises the nucleotide sequence SEQ ID NO: 1775. In some embodiments, the antisense strand consists of the nucleotide sequence SEQ ID NO: 2381, and the sense strand consists of the nucleotide sequence SEQ ID NO: 1775.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2387, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1781. In some embodiments, the antisense strand comprises a nucleotide sequence differing by no more than 4 nucleotides (for example, 1, 2, 3, or 4 nucleotides) from SEQ ID NO: 2387, and the sense strand comprises a nucleotide sequence differing by no more than 4 nucleotides (for example, 1, 2, 3, or 4 nucleotides) from SEQ ID NO: 1781. In some embodiments, the antisense strand comprises the nucleotide sequence SEQ ID NO: 2387, and the sense strand comprises the nucleotide sequence SEQ ID NO: 1781. In some embodiments, the antisense strand consists of the nucleotide sequence SEQ ID NO: 2387, and the sense strand consists of the nucleotide sequence SEQ ID NO: 1781.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2389, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1783. In some embodiments, the antisense strand comprises a nucleotide sequence differing by no more than 4 nucleotides (for example, 1, 2, 3, or 4 nucleotides) from SEQ ID NO: 2389, and the sense strand comprises a nucleotide sequence differing by no more than 4 nucleotides (for example, 1, 2, 3, or 4 nucleotides) from SEQ ID NO: 1783. In some embodiments, the antisense strand comprises the nucleotide sequence SEQ ID NO: 2389, and the sense strand comprises the nucleotide sequence SEQ ID NO: 1783. In some embodiments, the antisense strand consists of the nucleotide sequence SEQ ID NO: 2389, and the sense strand consists of the nucleotide sequence SEQ ID NO: 1783.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2392, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1786. In some embodiments, the antisense strand comprises a nucleotide sequence differing by no more than 4 nucleotides (for example, 1, 2, 3, or 4 nucleotides) from SEQ ID NO: 2392, and the sense strand comprises a nucleotide sequence differing by no more than 4 nucleotides (for example, 1, 2, 3, or 4 nucleotides) from SEQ ID NO: 1786. In some embodiments, the antisense strand comprises the nucleotide sequence SEQ ID NO: 2392, and the sense strand comprises the nucleotide sequence SEQ ID NO: 1786. In some embodiments, the antisense strand consists of the nucleotide sequence SEQ ID NO: 2392, and the sense strand consists of the nucleotide sequence SEQ ID NO: 1786.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2393, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1787. In some embodiments, the antisense strand comprises a nucleotide sequence differing by no more than 4 nucleotides (for example, 1, 2, 3, or 4 nucleotides) from SEQ ID NO: 2393, and the sense strand comprises a nucleotide sequence differing by no more than 4 nucleotides (for example, 1, 2, 3, or 4 nucleotides) from SEQ ID NO: 1787. In some embodiments, the antisense strand comprises the nucleotide sequence SEQ ID NO: 2393, and the sense strand comprises the nucleotide sequence SEQ ID NO: 1787. In some embodiments, the antisense strand consists of the nucleotide sequence SEQ ID NO: 2393, and the sense strand consists of the nucleotide sequence SEQ ID NO: 1787.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2396, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1790. In some embodiments, the antisense strand comprises a nucleotide sequence differing by no more than 4 nucleotides (for example, 1, 2, 3, or 4 nucleotides) from SEQ ID NO: 2396, and the sense strand comprises a nucleotide sequence differing by no more than 4 nucleotides (for example, 1, 2, 3, or 4 nucleotides) from SEQ ID NO: 1790. In some embodiments, the antisense strand comprises the nucleotide sequence SEQ ID NO: 2396, and the sense strand comprises the nucleotide sequence SEQ ID NO: 1790. In some embodiments, the antisense strand consists of the nucleotide sequence SEQ ID NO: 2396, and the sense strand consists of the nucleotide sequence SEQ ID NO: 1790.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2397, and the sense strand comprises a nucleotide sequence comprising at least 15 more than 4 nucleotides (for example, 1, 2, 3, or 4 nucleotides) from SEQ ID NO: 1791. In some embodiments, the antisense strand comprises a nucleotide sequence differing by no more than 4 nucleotides (for example, 1, 2, 3, or 4 nucleotides) from SEQ ID NO: 2397, and the sense strand comprises a nucleotide sequence differing by no more than 4 nucleotides (for example, 1, 2, 3, or 4 nucleotides) from SEQ ID NO: 1791. In some embodiments, the antisense strand comprises the nucleotide sequence SEQ ID NO: 2397, and the sense strand comprises the nucleotide sequence SEQ ID NO: 1791. In some embodiments, the antisense strand consists of the nucleotide sequence SEQ ID NO: 2397, and the sense strand consists of the nucleotide sequence SEQ ID NO: 1791.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2398, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1792. In some embodiments, the antisense strand comprises a nucleotide sequence differing by no more than 4 nucleotides (for example, 1, 2, 3, or 4 nucleotides) from SEQ ID NO: 2398, and the sense strand comprises a nucleotide sequence differing by no more than 4 nucleotides (for example, 1, 2, 3, or 4 nucleotides) from SEQ ID NO: 1792. In some embodiments, the antisense strand comprises the nucleotide sequence SEQ ID NO: 2398, and the sense strand comprises the nucleotide sequence SEQ ID NO: 1792. In some embodiments, the antisense strand consists of the nucleotide sequence SEQ ID NO: 2398, and the sense strand consists of the nucleotide sequence SEQ ID NO: 1792.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2402, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1796. In some embodiments, the antisense strand comprises a nucleotide sequence differing by no more than 4 nucleotides (for example, 1, 2, 3, or 4 nucleotides) from SEQ ID NO: 2402, and the sense strand comprises a nucleotide sequence differing by no more than 4 nucleotides (for example, 1, 2, 3, or 4 nucleotides) from SEQ ID NO: 1796. In some embodiments, the antisense strand comprises the nucleotide sequence SEQ ID NO: 2402, and the sense strand comprises the nucleotide sequence SEQ ID NO: 1796. In some embodiments, the antisense strand consists of the nucleotide sequence SEQ ID NO: 2402, and the sense strand consists of the nucleotide sequence SEQ ID NO: 1796.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2403, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1797. In some embodiments, the antisense strand comprises a nucleotide sequence differing by no more than 4 nucleotides (for example, 1, 2, 3, or 4 nucleotides) from SEQ ID NO: 2403, and the sense strand comprises a nucleotide sequence differing by no more than 4 nucleotides (for example, 1, 2, 3, or 4 nucleotides) from SEQ ID NO: 1797. In some embodiments, the antisense strand comprises the nucleotide sequence SEQ ID NO: 2403, and the sense strand comprises the nucleotide sequence SEQ ID NO: 1797. In some embodiments, the antisense strand consists of the nucleotide sequence SEQ ID NO: 2403, and the sense strand consists of the nucleotide sequence SEQ ID NO: 1797.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2404, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1798. In some embodiments, the antisense strand comprises a nucleotide sequence differing by no more than 4 nucleotides (for example, 1, 2, 3, or 4 nucleotides) from SEQ ID NO: 2404, and the sense strand comprises a nucleotide sequence differing by no more than 4 nucleotides (for example, 1, 2, 3, or 4 nucleotides) from SEQ ID NO: 1798. In some embodiments, the antisense strand comprises the nucleotide sequence SEQ ID NO: 2404, and the sense strand comprises the nucleotide sequence SEQ ID NO: 1798. In some embodiments, the antisense strand consists of the nucleotide sequence SEQ ID NO: 2404, and the sense strand consists of the nucleotide sequence SEQ ID NO: 1798.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2405, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1799. In some embodiments, the antisense strand comprises a nucleotide sequence differing by no more than 4 nucleotides (for example, 1, 2, 3, or 4 nucleotides) from SEQ ID NO: 2405, and the sense strand comprises a nucleotide sequence differing by no more than 4 nucleotides (for example, 1, 2, 3, or 4 nucleotides) from SEQ ID NO: 1799. In some embodiments, the antisense strand comprises the nucleotide sequence SEQ ID NO: 2405, and the sense strand comprises the nucleotide sequence SEQ ID NO: 1799. In some embodiments, the antisense strand consists of the nucleotide sequence SEQ ID NO: 2405, and the sense strand consists of the nucleotide sequence SEQ ID NO: 1799.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2406, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1800. In some embodiments, the antisense strand comprises a nucleotide sequence differing by no more than 4 nucleotides (for example, 1, 2, 3, or 4 nucleotides) from SEQ ID NO: 2406, and the sense strand comprises a nucleotide sequence differing by no more than 4 nucleotides (for example, 1, 2, 3, or 4 nucleotides) from SEQ ID NO: 1800. In some embodiments, the antisense strand comprises the nucleotide sequence SEQ ID NO: 2406, and the sense strand comprises the nucleotide sequence SEQ ID NO: 1800. In some embodiments, the antisense strand consists of the nucleotide sequence SEQ ID NO: 2406, and the sense strand consists of the nucleotide sequence SEQ ID NO: 1800.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2407, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1801. In some embodiments, the antisense strand comprises a nucleotide sequence differing by no more than 4 nucleotides (for example, 1, 2, 3, or 4 nucleotides) from SEQ ID NO: 2407, and the sense strand comprises a nucleotide sequence differing by no more than 4 nucleotides (for example, 1, 2, 3, or 4 nucleotides) from SEQ ID NO: 1801. In some embodiments, the antisense strand comprises the nucleotide sequence SEQ ID NO: 2407, and the sense strand comprises the nucleotide sequence SEQ ID NO: 1801. In some embodiments, the antisense strand consists of the nucleotide sequence SEQ ID NO: 2407, and the sense strand consists of the nucleotide sequence SEQ ID NO: 1801.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2412, and the sense strand comprises a nucleotide sequence comprising at least 15 more than 4 nucleotides (for example, 1, 2, 3, or 4 nucleotides) from SEQ ID NO: 1806. In some embodiments, the antisense strand comprises a nucleotide sequence differing by no more than 4 nucleotides (for example, 1, 2, 3, or 4 nucleotides) from SEQ ID NO: 2412, and the sense strand comprises a nucleotide sequence differing by no more than 4 nucleotides (for example, 1, 2, 3, or 4 nucleotides) from SEQ ID NO: 1806. In some embodiments, the antisense strand comprises the nucleotide sequence SEQ ID NO: 2412, and the sense strand comprises the nucleotide sequence SEQ ID NO: 1806. In some embodiments, the antisense strand consists of the nucleotide sequence SEQ ID NO: 2412, and the sense strand consists of the nucleotide sequence SEQ ID NO: 1806.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2416, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1810. In some embodiments, the antisense strand comprises a nucleotide sequence differing by no more than 4 nucleotides (for example, 1, 2, 3, or 4 nucleotides) from SEQ ID NO: 2416, and the sense strand comprises a nucleotide sequence differing by no more than 4 nucleotides (for example, 1, 2, 3, or 4 nucleotides) from SEQ ID NO: 1810. In some embodiments, the antisense strand comprises the nucleotide sequence SEQ ID NO: 2416, and the sense strand comprises the nucleotide sequence SEQ ID NO: 1810. In some embodiments, the antisense strand consists of the nucleotide sequence SEQ ID NO: 2416, and the sense strand consists of the nucleotide sequence SEQ ID NO: 1810.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2419, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1813. In some embodiments, the antisense strand comprises a nucleotide sequence differing by no more than 4 nucleotides (for example, 1, 2, 3, or 4 nucleotides) from SEQ ID NO: 2419, and the sense strand comprises a nucleotide sequence differing by no more than 4 nucleotides (for example, 1, 2, 3, or 4 nucleotides) from SEQ ID NO: 1813. In some embodiments, the antisense strand comprises the nucleotide sequence SEQ ID NO: 2419, and the sense strand comprises the nucleotide sequence SEQ ID NO: 1813. In some embodiments, the antisense strand consists of the nucleotide sequence SEQ ID NO: 2419, and the sense strand consists of the nucleotide sequence SEQ ID NO: 1813.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2420, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 1814. In some embodiments, the antisense strand comprises a nucleotide sequence differing by no more than 4 nucleotides (for example, 1, 2, 3, or 4 nucleotides) from SEQ ID NO: 2420, and the sense strand comprises a nucleotide sequence differing by no more than 4 nucleotides (for example, 1, 2, 3, or 4 nucleotides) from SEQ ID NO: 1814. In some embodiments, the antisense strand comprises the nucleotide sequence SEQ ID NO: 2420, and the sense strand comprises the nucleotide sequence SEQ ID NO: 1814. In some embodiments, the antisense strand consists of the nucleotide sequence SEQ ID NO: 2420, and the sense strand consists of the nucleotide sequence SEQ ID NO: 1814.

In some embodiments, the oligonucleotide of the present disclosure targets a sequence of nucleotides corresponding to any one of positions 61-79, 404-422, 412-430, 420-438, 668-686, 1163-1181, 1619-1637, 1628-1646, 1629-1647, 1635-1653, 1636-1654, 1651-1669, 1652-1670, 1653-1671, 1654-1672, 1655-1673, 1656-1674, 1213-1231, and 1267-1285 of SEQ ID NO: 2425 (NM_001306068.3).

In some embodiments, the oligonucleotide of the present disclosure targets a sequence of nucleotides corresponding to any one of positions 668-686, 1628-1646, 1635-1653, 1652-1670, 1654-1672, 1655-1673, and 1656-1674 of SEQ ID NO: 2425 (NM_001306068.3).

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from the nucleotide sequence of any one of SEQ ID NOs: 634, 832, 837, 838, 1020, 1039, 1048, 1049, 1055, 1056, 1064, 1065, 1066, 1067, 1068, 1069, 1122, 1169, 1184, 1846, 2044, 2049, 2232, 2251, 2260, 2261, 2267, 2268, 2276, 2277, 2278, 2279, 2280, 2281, 2381, 2396, 2050, 2437, 2438, 2439, 2440, 2441, 2442, 2443, 2334, 2444, 2445, 2446, and 2447, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from the nucleotide sequence of any one of SEQ ID NOs: 28, 226, 231, 232, 414, 433, 442, 443, 449, 450, 458, 459, 460, 461, 462, 463, 516, 563, 578, 1240, 1438, 1443, 1626, 1645, 1654, 1655, 1661, 1662, 1670, 1671, 1672, 1673, 1674, 1675, 1775, 1790, 1444, 2426, 2427, 2428, 2429, 2430, 2431, 2432, 1728, 2433, 2434, 2435, and 2436. In some embodiments, the antisense strand comprises a nucleotide sequence differing by no more than 4 nucleotides (for example, 1, 2, 3, or 4 nucleotides) from the nucleotide sequence of any one of SEQ ID NOs: 634, 832, 837, 838, 1020, 1039, 1048, 1049, 1055, 1056, 1064, 1065, 1066, 1067, 1068, 1069, 1122, 1169, 1184, 1846, 2044, 2049, 2232, 2251, 2260, 2261, 2267, 2268, 2276, 2277, 2278, 2279, 2280, 2281, 2381, 2396, 2050, 2437, 2438, 2439, 2440, 2441, 2442, 2443, 2334, 2444, 2445, 2446, and 2447, and the sense strand comprises a nucleotide sequence differing by no more than 4 nucleotides (for example, 1, 2, 3, or 4 nucleotides) from the nucleotide sequence of any one of SEQ ID NOs: 28, 226, 231, 232, 414, 433, 442, 443, 449, 450, 458, 459, 460, 461, 462, 463, 516, 563, 578, 1240, 1438, 1443, 1626, 1645, 1654, 1655, 1661, 1662, 1670, 1671, 1672, 1673, 1674, 1675, 1775, 1790, 1444, 2426, 2427, 2428, 2429, 2430, 2431, 2432, 1728, 2433, 2434, 2435, and 2436. In some embodiments, the antisense strand comprises the nucleotide sequence of any one of SEQ ID NOs: 634, 832, 837, 838, 1020, 1039, 1048, 1049, 1055, 1056, 1064, 1065, 1066, 1067, 1068, 1069, 1122, 1169, 1184, 1846, 2044, 2049, 2232, 2251, 2260, 2261, 2267, 2268, 2276, 2277, 2278, 2279, 2280, 2281, 2381, 2396, 2050, 2437, 2438, 2439, 2440, 2441, 2442, 2443, 2334, 2444, 2445, 2446, and 2447, and the sense strand comprises the nucleotide sequence of any one of SEQ ID NOs: 28, 226, 231, 232, 414, 433, 442, 443, 449, 450, 458, 459, 460, 461, 462, 463, 516, 563, 578, 1240, 1438, 1443, 1626, 1645, 1654, 1655, 1661, 1662, 1670, 1671, 1672, 1673, 1674, 1675, 1775, 1790, 1444, 2426, 2427, 2428, 2429, 2430, 2431, 2432, 1728, 2433, 2434, 2435, and 2436. In some embodiments, the antisense strand consists of the nucleotide sequence of any one of SEQ ID NOs: 634, 832, 837, 838, 1020, 1039, 1048, 1049, 1055, 1056, 1064, 1065, 1066, 1067, 1068, 1069, 1122, 1169, 1184, 1846, 2044, 2049, 2232, 2251, 2260, 2261, 2267, 2268, 2276, 2277, 2278, 2279, 2280, 2281, 2381, 2396, 2050, 2437, 2438, 2439, 2440, 2441, 2442, 2443, 2334, 2444, 2445, 2446, and 2447, and the sense strand consists of the nucleotide sequence of any one of SEQ ID NOs: 28, 226, 231, 232, 414, 433, 442, 443, 449, 450, 458, 459, 460, 461, 462, 463, 516, 563, 578, 1240, 1438, 1443, 1626, 1645, 1654, 1655, 1661, 1662, 1670, 1671, 1672, 1673, 1674, 1675, 1775, 1790, 1444, 2426, 2427, 2428, 2429, 2430, 2431, 2432, 1728, 2433, 2434, 2435, and 2436.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from an antisense strand selected from Table 1D, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from a sense strand selected from Table 1D. In some embodiments, the antisense strand comprises a nucleotide sequence differing by no more than 4 nucleotides (for example, 1, 2, 3, or 4 nucleotides) from an antisense strand selected from Table 1D, and the sense strand comprises a nucleotide sequence differing by no more than 4 nucleotides (for example, 1, 2, 3, or 4 nucleotides) from a sense strand selected from Table 1D. In some embodiments, the antisense strand comprises an antisense strand selected from Table 1D, and the sense strand comprises a sense strand selected from Table 1D. In some embodiments, the antisense strand consists of an antisense strand selected from Table 1D, and the sense strand consists of a sense strand selected from Table 1D.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from an antisense strand selected from Table 1E, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from a sense strand selected from Table 1E. In some embodiments, the antisense strand comprises a nucleotide sequence differing by no more than 4 nucleotides (for example, 1, 2, 3, or 4 nucleotides) from an antisense strand selected from Table 1E, and the sense strand comprises a nucleotide sequence differing by no more than 4 nucleotides (for example, 1, 2, 3, or 4 nucleotides) from a sense strand selected from Table 1E. In some embodiments, the antisense strand comprises an antisense strand selected from Table 1E, and the sense strand comprises a sense strand selected from Table 1E. In some embodiments, the antisense strand consists of an antisense strand selected from Table 1E, and the sense strand consists of a sense strand selected from Table 1E.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NOs: 634, 832, 837, 838, 1020, 1039, 1048, 1049, 1055, 1056, 1064, 1065, 1066, 1067, 1068, 1069, 1122, 1169, and 1184, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NOs: 28, 226, 231, 232, 414, 433, 442, 443, 449, 450, 458, 459, 460, 461, 462, 463, 516, 563, and 578. In some embodiments, the antisense strand comprises a nucleotide sequence differing by no more than 4 nucleotides (for example, 1, 2, 3, or 4 nucleotides) from SEQ ID NOs: 634, 832, 837, 838, 1020, 1039, 1048, 1049, 1055, 1056, 1064, 1065, 1066, 1067, 1068, 1069, 1122, 1169, and 1184, and the sense strand comprises a nucleotide sequence differing by no more than 4 nucleotides (for example, 1, 2, 3, or 4 nucleotides) from SEQ ID NOs: 28, 226, 231, 232, 414, 433, 442, 443, 449, 450, 458, 459, 460, 461, 462, 463, 516, 563, and 578. In some embodiments, the antisense strand comprises the nucleotide sequence SEQ ID NOs: 634, 832, 837, 838, 1020, 1039, 1048, 1049, 1055, 1056, 1064, 1065, 1066, 1067, 1068, 1069, 1122, 1169, and 1184, and the sense strand comprises the nucleotide sequence SEQ ID NOs: 28, 226, 231, 232, 414, 433, 442, 443, 449, 450, 458, 459, 460, 461, 462, 463, 516, 563, and 578. In some embodiments, the antisense strand consists of the nucleotide sequence SEQ ID NOs: 634, 832, 837, 838, 1020, 1039, 1048, 1049, 1055, 1056, 1064, 1065, 1066, 1067, 1068, 1069, 1122, 1169, and 1184, and the sense strand consists of the nucleotide sequence SEQ ID NOs: 28, 226, 231, 232, 414, 433, 442, 443, 449, 450, 458, 459, 460, 461, 462, 463, 516, 563, and 578.

In some embodiments, the antisense strand comprises a nucleotide sequence comprising at least 15 contiguous nucleotides (for example, 15, 16, 17, 18, 19, 20, or 21 contiguous nucleotides) differing by no more than 1, 2, 3, or 4 nucleotides from a sequence selected from SEQ ID NOs: 1048, 1055, 1065, 1067, 1068, 1069, and 1122. In some embodiments, the sense strand comprises a nucleotide sequence comprising at least 15 contiguous nucleotides (for example, 15, 16, 17, 18, or 19 contiguous nucleotides) differing by no more than 1, 2, 3, or 4 nucleotides from a nucleotide sequence selected from SEQ ID NOs: 442, 449, 459, 461, 462, 463, and 516.

In some embodiments, the antisense strand comprises a nucleotide sequence comprising at least 15 contiguous nucleotides (for example, 15, 16, 17, 18, 19, 20, or 21 contiguous nucleotides) differing by no more than 1, 2, 3, or 4 nucleotides from a sequence selected from SEQ ID NOs: 3441, 3448, 3458, 3460, 3461, 3462, and 3514. In some embodiments, the sense strand comprises a nucleotide sequence comprising at least 15 contiguous nucleotides (for example, 15, 16, 17, 18, or 19 contiguous nucleotides) differing by no more than 1, 2, 3, or 4 nucleotides from a nucleotide sequence selected from SEQ ID NOs: 2861, 2868, 2878, 2880, 2881, 2882, and 2923.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1048, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 442. In some embodiments, the antisense strand comprises a nucleotide sequence differing by no more than 4 nucleotides (for example, 1, 2, 3, or 4 nucleotides) from SEQ ID NO: 1048, and the sense strand comprises a nucleotide sequence differing by no more than 4 nucleotides (for example, 1, 2, 3, or 4 nucleotides) from SEQ ID NO: 442. In some embodiments, the antisense strand comprises the nucleotide sequence SEQ ID NO: 1048, and the sense strand comprises the nucleotide sequence SEQ ID NO: 442. In some embodiments, the antisense strand consists of the nucleotide sequence SEQ ID NO: 1048, and the sense strand consists of the nucleotide sequence SEQ ID NO: 442.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1055, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 449. In some embodiments, the antisense strand comprises a nucleotide sequence differing by no more than 4 nucleotides (for example, 1, 2, 3, or 4 nucleotides) from SEQ ID NO: 1055, and the sense strand comprises a nucleotide sequence differing by no more than 4 nucleotides (for example, 1, 2, 3, or 4 nucleotides) from SEQ ID NO: 449. In some embodiments, the antisense strand comprises the nucleotide sequence SEQ ID NO: 1055, and the sense strand comprises the nucleotide sequence SEQ ID NO: 449. In some embodiments, the antisense strand consists of the nucleotide sequence SEQ ID NO: 1055, and the sense strand consists of the nucleotide sequence SEQ ID NO: 449.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1065, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 459. In some embodiments, the antisense strand comprises a nucleotide sequence differing by no more than 4 nucleotides (for example, 1, 2, 3, or 4 nucleotides) from SEQ ID NO: 1065, and the sense strand comprises a nucleotide sequence differing by no more than 4 nucleotides (for example, 1, 2, 3, or 4 nucleotides) from SEQ ID NO: 459. In some embodiments, the antisense strand comprises the nucleotide sequence SEQ ID NO: 1065, and the sense strand comprises the nucleotide sequence SEQ ID NO: 459. In some embodiments, the antisense strand consists of the nucleotide sequence SEQ ID NO: 1065, and the sense strand consists of the nucleotide sequence SEQ ID NO: 459.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1067, and the sense strand comprises a nucleotide sequence comprising at least 15 contiguous nucleotides (for example, 15, 16, 17, 18, or 19 contiguous nucleotides)

differing by no more than 4 nucleotides (for example, 1, 2, 3, or 4 nucleotides) from SEQ ID NO: 461. In some embodiments, the antisense strand comprises a nucleotide sequence differing by no more than 4 nucleotides (for example, 1, 2, 3, or 4 nucleotides) from SEQ ID NO: 1067, and the sense strand comprises a nucleotide sequence differing by no more than 4 nucleotides (for example, 1, 2, 3, or 4 nucleotides) from SEQ ID NO: 461. In some embodiments, the antisense strand comprises the nucleotide sequence SEQ ID NO: 1067, and the sense strand comprises the nucleotide sequence SEQ ID NO: 461. In some embodiments, the antisense strand consists of the nucleotide sequence SEQ ID NO: 1067, and the sense strand consists of the nucleotide sequence SEQ ID NO: 461.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1068, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 462. In some embodiments, the antisense strand comprises a nucleotide sequence differing by no more than 4 nucleotides (for example, 1, 2, 3, or 4 nucleotides) from SEQ ID NO: 1068, and the sense strand comprises a nucleotide sequence differing by no more than 4 nucleotides (for example, 1, 2, 3, or 4 nucleotides) from SEQ ID NO: 462. In some embodiments, the antisense strand comprises the nucleotide sequence SEQ ID NO: 1068, and the sense strand comprises the nucleotide sequence SEQ ID NO: 462. In some embodiments, the antisense strand consists of the nucleotide sequence SEQ ID NO: 1068, and the sense strand consists of the nucleotide sequence SEQ ID NO: 462.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1069, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 463. In some embodiments, the antisense strand comprises a nucleotide sequence differing by no more than 4 nucleotides (for example, 1, 2, 3, or 4 nucleotides) from SEQ ID NO: 1069, and the sense strand comprises a nucleotide sequence differing by no more than 4 nucleotides (for example, 1, 2, 3, or 4 nucleotides) from SEQ ID NO: 463. In some embodiments, the antisense strand comprises the nucleotide sequence SEQ ID NO: 1069, and the sense strand comprises the nucleotide sequence SEQ ID NO: 463. In some embodiments, the antisense strand consists of the nucleotide sequence SEQ ID NO: 1069, and the sense strand consists of the nucleotide sequence SEQ ID NO: 463.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 1122, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 516. In some embodiments, the antisense strand comprises a nucleotide sequence differing by no more than 4 nucleotides (for example, 1, 2, 3, or 4 nucleotides) from SEQ ID NO: 1122, and the sense strand comprises a nucleotide sequence differing by no more than 4 nucleotides (for example, 1, 2, 3, or 4 nucleotides) from SEQ ID NO: 516. In some embodiments, the antisense strand comprises the nucleotide sequence SEQ ID NO: 1122, and the sense strand comprises the nucleotide sequence SEQ ID NO: 516. In some embodiments, the antisense strand consists of the nucleotide sequence SEQ ID NO: 1122, and the sense strand consists of the nucleotide sequence SEQ ID NO: 516.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2437, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2426. In some embodiments, the antisense strand comprises a nucleotide sequence differing by no more than 4 nucleotides (for example, 1, 2, 3, or 4 nucleotides) from SEQ ID NO: 2437, and the sense strand comprises a nucleotide sequence differing by no more than 4 nucleotides (for example, 1, 2, 3, or 4 nucleotides) from SEQ ID NO: 2426. In some embodiments, the antisense strand comprises the nucleotide sequence SEQ ID NO: 2437, and the sense strand comprises the nucleotide sequence SEQ ID NO: 2426. In some embodiments, the antisense strand consists of the nucleotide sequence SEQ ID NO: 2437, and the sense strand consists of the nucleotide sequence SEQ ID NO: 2426.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2438, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2427. In some embodiments, the antisense strand comprises a nucleotide sequence differing by no more than 4 nucleotides (for example, 1, 2, 3, or 4 nucleotides) from SEQ ID NO: 2438, and the sense strand comprises a nucleotide sequence differing by no more than 4 nucleotides (for example, 1, 2, 3, or 4 nucleotides) from SEQ ID NO: 2427. In some embodiments, the antisense strand comprises the nucleotide sequence SEQ ID NO: 2438, and the sense strand comprises the nucleotide sequence SEQ ID NO: 2427. In some embodiments, the antisense strand consists of the nucleotide sequence SEQ ID NO: 2438, and the sense strand consists of the nucleotide sequence SEQ ID NO: 2427.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2439, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2428. In some embodiments, the antisense strand comprises a nucleotide sequence differing by no more than 4 nucleotides (for example, 1, 2, 3, or 4 nucleotides) from SEQ ID NO: 2439, and the sense strand comprises a nucleotide sequence differing by no more than 4 nucleotides (for example, 1, 2, 3, or 4 nucleotides) from SEQ ID NO: 2428. In some embodiments, the antisense strand comprises the nucleotide sequence SEQ ID NO: 2439, and the sense strand comprises the nucleotide sequence SEQ ID NO: 2428. In some embodiments, the antisense strand consists of the nucleotide sequence SEQ ID NO: 2439, and the sense strand consists of the nucleotide sequence SEQ ID NO: 2428.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2440, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2429. In some embodiments, the antisense strand comprises a nucleotide sequence differing by no more than 4 nucleotides (for example, 1, 2, 3, or 4 nucleotides) from SEQ ID NO: 2440, and the sense strand comprises a nucleotide sequence differing by no more than 4 nucleotides (for example, 1, 2, 3, or 4 nucleotides) from SEQ ID NO: 2429. In some embodiments, the antisense strand comprises the nucleotide sequence SEQ ID NO: 2440, and the sense strand comprises the nucleotide sequence SEQ ID NO: 2429. In some embodiments, the antisense strand consists of the nucleotide sequence SEQ ID NO: 2440, and the sense strand consists of the nucleotide sequence SEQ ID NO: 2429.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2441, and the sense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2430. In some embodiments, the antisense strand comprises a nucleotide sequence differing by no more than 4 nucleotides (for example, 1, 2, 3, or 4 nucleotides) from SEQ ID NO: 2441, and the sense strand comprises a nucleotide sequence differing by no more than 4 nucleotides (for example, 1, 2, 3, or 4 nucleotides) from SEQ ID NO: 2430. In some embodiments, the antisense strand comprises the nucleotide sequence SEQ ID NO: 2441, and the sense strand comprises the nucleotide sequence SEQ ID NO: 2430. In some embodiments, the antisense strand consists of the nucleotide sequence SEQ ID NO: 2441, and the sense strand consists of the nucleotide sequence SEQ ID NO: 2430.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2442, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2431. In some embodiments, the antisense strand comprises a nucleotide sequence differing by no more than 4 nucleotides (for example, 1, 2, 3, or 4 nucleotides) from SEQ ID NO: 2442, and the sense strand comprises a nucleotide sequence differing by no more than 4 nucleotides (for example, 1, 2, 3, or 4 nucleotides) from SEQ ID NO: 2431. In some embodiments, the antisense strand comprises the nucleotide sequence SEQ ID NO: 2442, and the sense strand comprises the nucleotide sequence SEQ ID NO: 2431. In some embodiments, the antisense strand consists of the nucleotide sequence SEQ ID NO: 2442, and the sense strand consists of the nucleotide sequence SEQ ID NO: 2431.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2443, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2432. In some embodiments, the antisense strand comprises a nucleotide sequence differing by no more than 4 nucleotides (for example, 1, 2, 3, or 4 nucleotides) from SEQ ID NO: 2443, and the sense strand comprises a nucleotide sequence differing by no more than 4 nucleotides (for example, 1, 2, 3, or 4 nucleotides) from SEQ ID NO: 2432. In some embodiments, the antisense strand comprises the nucleotide sequence SEQ ID NO: 2443, and the sense strand comprises the nucleotide sequence SEQ ID NO: 2432. In some embodiments, the antisense strand consists of the nucleotide sequence SEQ ID NO: 2443, and the sense strand consists of the nucleotide sequence SEQ ID NO: 2432.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2444, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2433. In some embodiments, the antisense strand comprises a nucleotide sequence differing by no more than 4 nucleotides (for example, 1, 2, 3, or 4 nucleotides) from SEQ ID NO: 2444, and the sense strand comprises a nucleotide sequence differing by no more than 4 nucleotides (for example, 1, 2, 3, or 4 nucleotides) from SEQ ID NO: 2433. In some embodiments, the antisense strand comprises the nucleotide sequence SEQ ID NO: 2444, and the sense strand comprises the nucleotide sequence SEQ ID NO: 2433. In some embodiments, the antisense strand consists of the nucleotide sequence SEQ ID NO: 2444, and the sense strand consists of the nucleotide sequence SEQ ID NO: 2433.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2445, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2434. In some embodiments, the antisense strand comprises a nucleotide sequence differing by no more than 4 nucleotides (for example, 1, 2, 3, or 4 nucleotides) from SEQ ID NO: 2445, and the sense strand comprises a nucleotide sequence differing by no more than 4 nucleotides (for example, 1, 2, 3, or 4 nucleotides) from SEQ ID NO: 2434. In some embodiments, the antisense strand comprises the nucleotide sequence SEQ ID NO: 2445, and the sense strand comprises the nucleotide sequence SEQ ID NO: 2434. In some embodiments, the antisense strand consists of the nucleotide sequence SEQ ID NO: 2445, and the sense strand consists of the nucleotide sequence SEQ ID NO: 2434.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2446, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2435. In some embodiments, the antisense strand comprises a nucleotide sequence differing by no more than 4 nucleotides (for example, 1, 2, 3, or 4 nucleotides) from SEQ ID NO: 2446, and the sense strand comprises a nucleotide sequence differing by no more than 4 nucleotides (for example, 1, 2, 3, or 4 nucleotides) from SEQ ID NO: 2435. In some embodiments, the antisense strand comprises the nucleotide sequence SEQ ID NO: 2446, and the sense strand comprises the nucleotide sequence SEQ ID NO: 2435. In some embodiments, the antisense strand consists of the nucleotide sequence SEQ ID NO: 2446, and the sense strand consists of the nucleotide sequence SEQ ID NO: 2435.

In some embodiments, the antisense strand comprises a nucleotide sequence comprising at least 15 contiguous nucleotides (for example, 15, 16, 17, 18, 19, 20, or 21 contiguous nucleotides) differing by no more than 4 nucleotides (for example, 1, 2, 3, or 4 nucleotides) from SEQ ID NO: 2447, and the sense strand comprises a nucleotide sequence comprising at least 15 contiguous nucleotides (for example, 15, 16, 17, 18, or 19 contiguous nucleotides) differing by no more than 4 nucleotides (for example, 1, 2, 3, or 4 nucleotides) from SEQ ID NO: 2436. In some embodiments, the antisense strand comprises a nucleotide sequence differing by no more than 4 nucleotides (for example, 1, 2, 3, or 4 nucleotides) from SEQ ID NO: 2447, and the sense strand comprises a nucleotide sequence differing by no more than 4 nucleotides (for example, 1, 2, 3, or 4 nucleotides) from SEQ ID NO: 2436. In some embodiments, the antisense strand comprises the nucleotide sequence SEQ ID NO: 2447, and the sense strand comprises the nucleotide sequence SEQ ID NO: 2436. In some embodiments, the antisense strand consists of the nucleotide sequence SEQ ID NO: 2447, and the sense strand consists of the nucleotide sequence SEQ ID NO: 2436.

A DUX4 RNAi agent described herein can contain one or more mismatches to the target sequence. In some embodiments, a DUX4 RNAi agent as described herein contains no more than 4 mismatches (e.g., no more than 4, 3, 2, 1, or 0 mismatches to the target sequence). If the antisense strand of the RNAi agent contains mismatches to a target sequence, it may be preferable that the area of mismatch is not located in the center of the region of complementarity. If the antisense strand of the RNAi agent contains mismatches to the target sequence, it may be preferable that the mismatch be restricted to be within the last 5 nucleotides from either the 5'- or 3'-end of the region of complementarity. For example, for a 21 nucleotide RNAi agent, the strand which is complementary to a region of, e.g., DUX4, generally does not contain any mismatch within the central 11 nucleotides. The methods described herein or methods known in the art can be used to determine whether an RNAi agent containing a mismatch to a target sequence is effective in inhibiting the expression of DUX4. Consideration of the efficacy of RNAi agents with mismatches in inhibiting expression of a target gene is important, especially if the particular region of complementarity in a target gene is known to have polymorphic sequence variation within the population.

In some embodiments, any one of the RNAi agents described herein can reduce expression levels of DUX4. In some embodiments, reduction in expression levels is assayed using a DUX4 reporter construct, e.g., see Examples 1 and 2. In some embodiments, DUX4 RNA expression is measured using a reporter or tag (e.g., luciferase, or fluorescent tag). The skilled artisan will appreciate that various approaches to generating a reporter construct for assessing RNAi agent activity may be used in the art, including commercially available kits, e.g., the psiCHECK-2 vector (Promega). In some embodiments, any one of the RNAi agents described herein can reduce expression levels of a DUX4 reporter when assayed in cultured cells. Any suitable cells known in the art may be used to assess the RNAi agents. In some embodiments, the cultured cells are Hepal-6. In some embodiments, administration of any one of the RNAi agents disclosed herein to a cultured cell results in a reduction in expression level of a DUX4. In some embodiments, administration of the RNAi agent results in at least a 55% reduction in expression levels of the DUX4 reporter. In some embodiments, administration of the RNAi agent results in at least a 60% reduction in expression levels of the DUX4 reporter. In some embodiments, administration of the RNAi agent results in at least a 65% reduction in expression levels of the DUX4 reporter. In some embodiments, administration of the RNAi agent results in at least a 70% reduction in expression levels of the DUX4 reporter. In some embodiments, administration of the RNAi agent results in at least a 75% reduction in expression levels of the DUX4 reporter. In some embodiments, administration of the RNAi agent results in at least an 80% reduction in expression levels of the DUX4 reporter. In some embodiments, administration of the RNAi agent results in at least a 85% reduction in expression levels of the DUX4 reporter. In some embodiments, administration of the RNAi agent results in at least a 90% reduction in expression levels of the DUX4 reporter. In some embodiments, administration of the RNAi agent results in at least a 95% reduction in expression levels of the DUX4 reporter.

In some embodiments, reduction in expression levels is assayed using an RT-qPCR assay, e.g., see Example 3, to perform relative quantification of mRNA expression of a DUX4 panel, e.g., a panel of DUX4's targets, in cardiomyocytes (e.g., FSHD MB200 cells, which is human myoblast cell line used to study facioscapulohumeral muscular dystrophy (FSHD)). In some embodiments, reduction in DUX4 expression is assessed by determining the mRNA expression level of a panel of DUX4 targets, e.g., a DUX4 panel comprising one or more gene of CCNA1, SLC34A2, ZSCAN4, PRAMEF2, PRAMEF17, PRAMEF12, LEUTX, HNRNPCL1, RFPL4B, PRAMEF1, PRAMEF19, TRIM43B, TRIM43, PRAMEF14, PRAMEF11, KDM4E, RFPL2, PRAMEF15, PRAMEF6, ZNF280A, PRAMEF9, TRIM49, KHDC1P1, PRAMEF4, TPRX1, TRIM49B, TRIM51CP, KLF17, TRIM51BP, TRIM53CP, C1DP2, TRIM53AP, TRIM51, PRAMEF8, MBD3L2B, KHDC1L, ALPG, TRIM49C, MBD3L2, ZNF705G, MBD3L3, PRAMEF7, TRIM43CP, PRAMEF10, HNRNPCL4, TRIM53BP, TRIM51EP, or MBD3L5. In some embodiments, the reduction in DUX4 expression is assessed by determining the mRNA expression level of a panel of DUX4 targets, e.g., a DUX4 panel comprising one or more of LEUTX, TRIM43, KHDC1L, MBD3L2, CCNA1, ZSCAN4, SLC34A2, or PRAMEF6. In some embodiments, the reduction in DUX4 expression is assessed by determining the mRNA expression level of a panel of DUX4 targets, e.g., a DUX4 panel comprising one or more of KHDC1L, LEUTX, MBD3L2, and ZSCAN4. The skilled artisan will appreciate that various approaches to quantify knockdown of DUX4 expression (e.g., via quantify of expression of the DUX4 panel) for assessing RNAi agent activity may be used in the art, including commercially available kits, e.g., from Thermo. In some embodiments, any one of the RNAi agents described herein can reduce mRNA expression level of the DUX4 panel when assayed in cultured cells. Any suitable cells known in the art may be used to assess the RNAi agents. In some embodiments, the cultured cells are FSHD MB200 cells. In some embodiments, administration of any one of the RNAi agents disclosed herein to a cultured cell results in a reduction in mRNA expression level of the DUX4 panel. In some embodiments, administration of the RNAi agent results in at least a 30% reduction in mRNA expression level of the DUX4 panel. In some embodiments, administration of the RNAi agent results in at least a 35% reduction in mRNA expression level of the DUX4 panel. In some embodiments, administration of the RNAi agent results in at least a 40% reduction in mRNA expression level of the DUX4 panel. In some embodiments, administration of the RNAi agent results in at least a 45% reduction in mRNA expression level of the DUX4 panel. In some embodiments, administration of the RNAi agent results in at least a 50% reduction in mRNA expression level of the DUX4 panel. In some embodiments, administration of the RNAi agent results in at least a 55% reduction in mRNA expression level of the DUX4 panel. In some embodiments, administration of the RNAi agent results in at least a 60% reduction in mRNA expression level of the DUX4 panel. In some embodiments, administration of the RNAi agent results in at least a 65% reduction in mRNA expression level of the DUX4 panel. In some embodiments, administration of the RNAi agent results in at least a 70% reduction in mRNA expression level of the DUX4 panel. In some embodiments, administration of the RNAi agent results in at least a 75% reduction in mRNA expression level of the DUX4 panel. In some embodiments, administration of the RNAi agent results in at least an 80% reduction in mRNA expression level of the DUX4 panel. In some embodiments, administration of the RNAi agent results in at least an 85% reduction in mRNA expression level of the DUX4 panel. In some embodiments, administration of the RNAi agent results in at least a 90% reduction in mRNA expression level of the DUX4 panel. In some embodiments, administration of the RNAi agent results in at least a 95% reduction in mRNA expression level of the DUX4 panel.

Single-Stranded Antisense Oligonucleotides

In some embodiments, the oligonucleotide is a single-stranded antisense oligonucleotide, or "ASO." ASOs comprise an antisense strand with at least partial complementary to a target sequence in an RNA. Upon binding to a target sequence, downregulation of the RNA may be achieved through various mechanisms, including, but not limited to, sterically blocking translation or recruitment of RNase H.

In some embodiments, the ASO comprises a nucleic acid sequence of at least 14 contiguous nucleotides (for example, 14, 15, 16, 17, 18, 19, 20, or 21 contiguous nucleotides) that differ by no more than 1, 2, 3, or 4 nucleotides from any one of SEQ ID NOs: 607-1212 or 1819-2424. In some embodiments, the ASO comprises a nucleotide sequence of any one of SEQ ID NOs: 607-1212 or 1819-2424. In some embodiments, the ASO comprises a nucleic acid sequence of at least 14 contiguous nucleotides (for example, 14, 15, 16, 17, 18, 19, 20, or 21 contiguous nucleotides) that differ by no more than 1, 2, 3, or 4 nucleotides from any one of SEQ ID NOs: 2437-2447. In some embodiments, the ASO comprises a nucleotide sequence of any one of SEQ ID NOs: 2437-2447.

In some embodiments, the single-stranded ASO comprises a nucleic acid sequence comprising at least 14, 15, 16, 17, 18, 19, 20, or 21 contiguous nucleotides that differ by no more than 1, 2, 3, or 4 nucleotides from any one of SEQ ID NOs: 634, 832, 837, 838, 1020, 1039, 1048, 1049, 1055, 1056, 1064, 1065, 1066, 1067, 1068, 1069, 1122, 1169, 1184, 1846, 2044, 2049, 2232, 2251, 2260, 2261, 2267, 2268, 2276, 2277, 2278, 2279, 2280, 2281, 2381, 2396, 2050, 2437, 2438, 2439, 2440, 2441, 2442, 2443, 2334, 2444, 2445, 2446, and 2447.

In some embodiments, the ASO comprises 2'-deoxy ribonucleotides and phosphorothioate internucleoside linkages.

In some embodiments, the ASO is a "gapmer" ASO comprising a 2'-deoxy "gap" region flanked by "wings" having nucleotides with 2'-modified ribonucleotides. In some embodiments, the ASO is an "MOE gapmer" in which the 2'-modified ribonucleotide is a 2'-O-methoxyethyl (2'-MOE or simply MOE) modification, and each of the internucleoside linkages is a phosphorothioate.

Modified Nucleotides

The oligonucleotides disclosed herein may be modified or unmodified. In some embodiments, any one of the oligonucleotides contain one or more modifications. As used herein, a modification to a nucleotide or "modified nucleotide" refers to any nucleotide other than the canonical ribonucleotides adenine, guanine, cytosine, and uracil.

In some embodiments, the oligonucleotide comprises one or more modified nucleotides. In some embodiments, no more than 1, 2, 3, 4, or 5 of the nucleotides of the oligonucleotide are unmodified nucleotides. In some embodiments, all nucleotides of the oligonucleotide are modified nucleotides.

In some embodiments, wherein the oligonucleotide is an RNAi agent, the antisense strand comprises one or more modified nucleotides. In some embodiments, no more than 1, 2, 3, 4, or 5 of the nucleotides of the antisense strand are unmodified nucleotides. In some embodiments, all nucleotides of the antisense strand are modified nucleotides.

In some embodiments, wherein the oligonucleotide is an RNAi agent, the sense strand comprises one or more modified nucleotides. In some embodiments, no more than 1, 2, 3, 4, or 5 of the nucleotides of the sense strand are unmodified nucleotides. In some embodiments, all nucleotides of the sense strand are modified nucleotides.

Modified nucleotides include, but are not limited to 2'-modified nucleotides, 3' to 3' linkages (inverted) nucleotides, bridged nucleotides, 2',3'-seco nucleotide mimics (e.g., unlocked nucleobase analogues (UNAs), locked nucleotides (LNAs), 5'-(S)-methyl-2'-deoxy-2'-fluoronucleotide (5'Me-Nf), vinyl phosphonate deoxyribonucleotides, vinyl phosphonate nucleotides, a nucleotide comprising a 5'-phosphorothioate group, a nucleotide comprising a 5'-methylphosphonate group, a nucleotide comprising a 5' phosphate or 5' phosphate mimic and N-(methane sulfonyl) phosphoramidate group. In some embodiments, 2'-modified nucleotides (e.g., a nucleotide with a group other than a hydroxyl group at the 2' position of the five-membered sugar ring) include, but are not limited to, 2'-O-methyl nucleotides (represented herein as a lower case letter n in a nucleotide sequence), 2'-deoxy-2'-fluoro nucleotides (represented herein as Nf, also represented herein as 2'-fluoro nucleotide). In some embodiments, a modified nucleotide is a nucleotide comprising a 5'-methylphosphate group. In some embodiments, a modified nucleotide is a nucleotide comprising a 5'-C-methylphosphate group.

In some embodiments, modified nucleotides include, but are not limited to, deoxyribonucleotides, nucleotide mimics, abasic nucleotides, 5' to 5' linkages (inverted) nucleotides, non-natural base-comprising nucleotides, peptide nucleic acids (PNAs), 3'-O-methoxy (2' internucleoside linked) nucleotides, 2'-deoxy-2'-fluoro-arabino nucleotides, cyclopropyl phosphonate nucleotides (cPrpN), vinyl phosphonate 2'-(methoxyethyl) unlocked nucleotides, a nucleotide comprising 2-hydroxymethyl-tetrahydrofurane-5-phosphate, 2'-deoxy nucleotides (represented herein as dN), 2'-methoxy ethyloxy (2'-O-(2-methoxylethyl)) nucleotides, 2'-amino nucleotides, and 2'-alkyl nucleotides. It is not necessary for all positions in a given compound to be uniformly modified. Conversely, more than one modification may be incorporated in a single oligonucleotide. Modification at one nucleotide is independent of modification at another nucleotide.

In some embodiments, the nucleotide modification comprises a deoxyribonucleotide, a 3'-terminal deoxythymidine (dT) nucleotide, an abasic nucleotide, a 2'-modified nucleotide, a 3' to 3' linkages (inverted) nucleotide, a 5' to 5' linkages (inverted) nucleotide, a non-natural base-comprising nucleotide, a nucleotide comprising a 5'-phosphorothioate group, a nucleotide comprising a 5'-methylphosphonate group, a nucleotide comprising a 5' phosphate or 5' phosphate mimic, a nucleotide comprising 2-hydroxymethyl-tetrahydrofurane-5-phosphate, or a nucleotide comprising a N-(methane sulfonyl) phosphoramidate group. In some embodiments, the nucleotide modification comprises a nucleotide comprising a 5'-methylphosphate group. In some embodiments, a modified nucleotide is a nucleotide comprising a 5'-C-methylphosphate group. In some embodiments, the oligonucleotide comprises a modified nucleotide selected from the group consisting of a deoxy nucleotide, a 3'-terminal deoxythymidine (dT) nucleotide, a 3'-3' inverted nucleotide linkage, a 5'-5' inverted nucleotide linkage, a 5'-(E)-vinylphosphonate-2'-O-methyl-uridine-3'-phosphate, a 5'-(E)-vinylphosphonate-2'-O-methyl-uridine-3'-phosphorothioate, and a combination thereof.

In some embodiments, the one or more modifications is selected from a ribose modification, a backbone modification, a nucleobase modification, or a combination thereof. In some embodiments, the one or more modifications is a combination of a ribose modification, a backbone modification, and/or a nucleobase modification.

In some embodiments, the ribose modification comprises a locked nucleic acid (LNA), a tricyclo-DNA (tcDNA), 2'-deoxy-2'-fluoro, 2'-O-methyl, 2'-methoxyethyl (2'-MOE), 2'-deoxy-2'-arabino-fluoro, 2'-O-benzyl, 2'-O-methyl-4-pyridine, 2' cyclic ethyl (cET), phosphorodiamidate morpholino (PMO), glycol nucleic acid (GNA), unlocked nucleic acid (UNA), a threose nucleic acid (TNA), or a combination thereof. In some embodiments, the ribose modification comprises a 2'-deoxy-2'-fluoro, 2'-O-methyl, 2'-methoxyethyl (2'-MOE), glycol nucleic acid (GNA), unlocked nucleic acid (UNA), a threose nucleic acid (TNA), or a combination thereof. In some embodiments, the ribose modification comprises a 2'-deoxy-2'-fluoro, 2'-O-methyl, glycol nucleic acid (GNA), unlocked nucleic acid (UNA), a threose nucleic acid (TNA), or a combination thereof. In some embodiments, the ribose modification is 2'-deoxy-2'-fluoro modification, a 2'-O-methyl modification, or a combination thereof.

In some embodiments, the oligonucleotide comprises one or more nucleobase modifications. Nucleobase modifications include, for example, synthetic and natural nucleobases, such as 5-substituted pyrimidines, 6-azapyrimidines and N-2, N-6 and 0-6 substituted purines, (e.g., 2-aminopropyladenine, 5-propynyluracil, or 5-propynylcytosine), 5-methylcytosine (5-me-C), 5-hydroxymethyl cytosine, xanthine, hypoxanthine, 2-aminoadenine, 6-alkyl (e.g., 6-methyl, 6-ethyl, 6-isopropyl, or 6-n-butyl) derivatives of adenine and guanine, 2-alkyl (e.g., 2-methyl, 2-ethyl, 2-isopropyl, or 2-n-butyl) and other alkyl derivatives of adenine and guanine, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7-methylguanine and 7-methyladenine, 8-azaguanine and 8-azaadenine, 7-deazaguanine, 7-deazaadenine, 3-deazaguanine, and 3-deazaadenine, or combinations thereof.

In some embodiments, the oligonucleotide comprises one or more backbone modification or non-standard linkages (e.g., modified internucleoside linkages). In some embodiments, a backbone modification is a non-phosphate-containing covalent internucleoside linkage. Modified internucleoside linkages or backbones include, but are not limited to, 5'-phosphorothioate groups (represented herein as a lower case “s”), chiral phosphorothioates, thiophosphates, phosphorodithioates, phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some embodiments, a modified backbone or modified internucleoside linkage lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide backbones, sulfoxide backbones, sulfone backbones, formacetyl and thioformacetyl backbones, methylene formacetyl and thioform acetyl backbones, alkene-containing backbones, sulfamate backbones, methyieneimino and methylenehydrazino backbones, sulfonate and sulfonamide backbones, amide backbones, and other backbones having mixed N, O, S, and $CH_2$ components.

In some embodiments, the backbone modification comprises phosphorothioate.

In some embodiments, any one of the oligonucleotides disclosed herein further comprise a sequence of 3'-terminal deoxythymidine (dT) nucleotides. In some embodiments, any one of the antisense strands described herein further comprises at least one terminal dT nucleotide. In some embodiments, any one of the antisense strands described herein further comprises 2 or more terminal dT nucleotides, e.g., 2, 3, 4, or more terminal dT nucleotides. In some embodiments, wherein the oligonucleotide is an RNAi agent, any one of the sense strands described herein further comprises at least one terminal dT nucleotide. In some embodiments, any one of the sense strands described herein further comprises 2 or more terminal dT nucleotides, e.g., 2, 3, 4, or more terminal dT nucleotides. In some embodiments, the antisense and sense strand of an RNAi agent herein each contain one or more terminal dT nucleotides.

In some embodiments, any one of the oligonucleotides disclosed herein further comprises at least one phosphorothioate internucleoside or phosphorodithioate internucleoside linkage. In some embodiments, any one of the oligonucleotides disclosed herein further comprises at least one phosphorothioate internucleoside linkage. In some embodiments, at least one phosphorothioate internucleoside linkage is at the 5' end of the antisense strand. In some embodiments, the oligonucleotide comprises at least 2 phosphorothioate internucleoside linkages at the 5' end of the antisense strand. In some embodiments, at least one phosphorothioate internucleoside linkage is at the 3' end of the antisense strand. In some embodiments, the oligonucleotide comprises at least 2 phosphorothioate internucleoside linkages at the 3' end of the antisense strand. In some embodiments, wherein the oligonucleotide is an RNAi agent, the at least one phosphorothioate internucleoside linkage is at the 5' end of the sense strand. In some embodiments, the oligonucleotide comprises at least 2 phosphorothioate internucleoside linkages at the 5' end of the sense strand. In some embodiments, the at least one phosphorothioate internucleoside linkage is at the 3' end of the sense strand. In some embodiments, the oligonucleotide comprises at least 2 phosphorothioate internucleoside linkages at the 3' end of the sense strand.

In some embodiments, any one of the oligonucleotides disclosed herein further comprises a terminal, chiral modification. In some embodiments, the terminal chiral modification is at the first internucleoside linkage at the 3' end of the sense and/or antisense strand. In some embodiments, the terminal chiral modification is at the first and second internucleoside linkage at the 3' end of the sense and/or antisense strand. In some embodiments, the chiral modification comprises a phosphorus atom of the internucleoside linkage being in either Rp or Sp configuration. In some embodiments, the siRNA agent further comprises a terminal, chiral modification occurring at the first internucleoside linkage at the 3' end of the antisense strand, having the linkage phosphorus atom in Sp configuration, a terminal, chiral modification occurring at the first internucleoside linkage at the 5' end of the antisense strand, having the linkage phosphorus atom in Rp configuration, and a terminal, chiral modification occurring at the first internucleoside linkage at the 5' end of the sense strand, having the linkage phosphorus atom in either Rp configuration or Sp configuration. In some embodiments, the siRNA agent further comprises a terminal, chiral modification occurring at the first and second internucleoside linkages at the 3' end of the antisense strand, having the linkage phosphorus atom in Sp configuration, a terminal, chiral modification occurring at the first internucleoside linkage at the 5' end of the antisense strand, having the linkage phosphorus atom in Rp configuration, and a terminal, chiral modification occurring at the first internucleoside linkage at the 5' end of the sense strand, having the linkage phosphorus atom in either Rp or Sp configuration. In some embodiments, the siRNA agent further comprises a terminal, chiral modification occurring at the first, second, and third internucleoside linkages at the 3' end of the antisense strand, having the linkage phosphorus atom in Sp configuration, a terminal, chiral modification occurring at the first internucleoside linkage at the 5' end of the antisense strand, having the linkage phosphorus atom in Rp configuration, and a terminal, chiral modification occurring at the first internucleoside linkage at the 5' end of the sense strand, having the linkage phosphorus atom in either Rp or Sp configuration. In some embodiments, the siRNA agent further comprises a terminal, chiral modification occurring at the first and second internucleoside linkages at the 3' end of the antisense strand, having the linkage phosphorus atom in Sp configuration, a terminal, chiral modification occurring at the third internucleoside linkages at the 3' end of the antisense strand, having the linkage phosphorus atom in Rp configuration, a terminal, chiral modification occurring at the first internucleoside linkage at the 5' end of the antisense strand, having the linkage phosphorus atom in Rp configuration, and a terminal, chiral modification occurring at the first internucleoside linkage at the 5' end of the sense strand, having the linkage phosphorus atom in either Rp or Sp configuration. In some embodiments, the siRNA agent further comprises a terminal, chiral modification occurring at the first and second internucleoside linkages at the 3' end of the antisense strand, having the linkage phosphorus atom in Sp configuration, a terminal, chiral modification occurring at the first and second internucleoside linkages at the 5' end of the antisense strand, having the linkage phosphorus atom in Rp configuration, and a terminal, chiral modification occurring at the first internucleoside linkage at the 5' end of the sense strand, having the linkage phosphorus atom in either Rp or Sp configuration.

In some embodiments, any one of the oligonucleotides disclosed herein further comprises a phosphate or phosphate mimic at the 5'-end of the antisense strand. In some embodiments, a phosphate or phosphate mimic at the 5'-end of the antisense strand is a 5'-vinyl phosphonate (VP). In some embodiments, a phosphate or phosphate mimic at the 5'-end of the antisense strand is a 5'-(E)-vinyl phosphonate (VP).

RNAi Agent Modification Motifs

In some embodiments, any one of the antisense or sense strands disclosed herein are modified according to a modification motif or pattern.

In some embodiments, an antisense strand disclosed herein comprises a modification pattern nsNfsnnnNfnNfNfnnnnNfnNfnnnsnsn, wherein ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

In some embodiments, an antisense strand disclosed herein comprises a modification pattern vpUs-NfsnnnNfnNfNfnnnnNfnNfnnnsnsn, wherein vpUs is a 5'-vinylphosphonate-2'-O-methyl-uridine-3'-phosphorothioate; ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

In some embodiments, a sense strand disclosed herein comprises a modification pattern nsnsnnNfnNfNfNfnnnnnnnnnn, wherein ns is a 2'-O-methyl-nucleoside-3'-phosphorothioate; n is a 2'-O-methyl-nucleoside-3'-phosphate; and Nf is a 2'-deoxy-2'-fluoro-nucleoside-3'-phosphate.

In some embodiments, a sense strand disclosed herein comprises a modification pattern NfsnsNfnNfnNfnNfnNfnNfnNfnNfnNf, wherein ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

In some embodiments, an RNAi agent disclosed herein comprises a sense strand and an antisense strand, wherein the sense strand comprises a modification pattern nsnsnnNfnNfNfNfnnnnnnnnnn, and the antisense strand comprises a modification pattern nsNfsnnnNfnNf NfnnnnNfnNfnnnsnsn, wherein ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

In some embodiments, an RNAi agent disclosed herein comprises a sense strand and an antisense strand, wherein the sense strand comprises a modification pattern nsnsnnNfnNfNfNfnnnnnnnnnn, and the antisense strand comprises a modification pattern vpUsNfsnnn NfnNfNfnnnnNfnNfnnnsnsn, wherein vpUs is a 5'-vinylphosphonate-2'-O-methyl-uridine-3'-phosphorothioate; ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

In some embodiments, a strand of an RNAi agent comprises a modification pattern according to $Nfs_a(nNf)_bns_cn$, wherein n is a 2'-O-methyl-nucleoside-3'-phosphate; Nfs is a 2'-deoxy-2'-fluoro-nucleoside-3'-phosphorothioate; Nf is a 2'-deoxy-2'-fluoro-nucleoside-3'-phosphate; and ns is a 2'-O-methyl-nucleoside-3'-phosphorothioate; and wherein a is at least 1, b is 5-10, and c is at least 1. In some embodiments, a is at least 2, b is at least 8, and c is at least 2. In some embodiments, a is 2, b is 8, and c is 2. In some embodiments, the strand of the RNAi agent comprises the modification pattern NfsNfsnNfnNfnNfnNfnNfnNfnNfnNfnsnsn. In some embodiments, the strand is the antisense strand. In some embodiments, the antisense strand comprises the sequence of any one of SEQ ID Nos: 607-1212 or 1819-2424. In some embodiments, the antisense strand comprises the sequence of any one of SEQ ID NOs: 2437-2447. In some embodiments, the strand is the sense strand. In some embodiments, the sense strand comprises the sequence of any one of SEQ ID NOs: 1-606 or 1213-1818. In some embodiments, the sense strand comprises the sequence of any one of SEQ ID NOs: 2426-2436.

In some embodiments, a strand of an RNAi agent comprises a modification pattern according $ns_d(Nfn)_eNf$, wherein n is a 2'-O-methyl-nucleoside-3'-phosphate; Nf is a 2'-deoxy-2'-fluoro-nucleoside-3'-phosphate; and ns is a 2'-O-methyl-nucleoside-3'-phosphorothioate; and wherein d is at least 1, and e is 5-10. In some embodiments, d is at least 2 and e is at least 8. In some embodiments, the RNAi agent comprises the modification pattern nsnsNfnNfn NfnNfnNfnNfnNfnNfnNf. In some embodiments, the strand is the sense strand. In some embodiments, the sense strand comprises the sequence of any one of SEQ ID NOs: 1-606 or 1213-1818. In some embodiments, the sense strand comprises the sequence of any one of SEQ ID NOs: 2426-2436. In some embodiments, the RNAi agent comprises the modification pattern nsnsNfnNfnNfnNfnNfnNfn NfnNfnNfnsn. In some embodiments, the strand is the antisense strand. In some embodiments, the antisense strand comprises the sequence of any one of SEQ ID NOs: 607-1212 or 1819-2424. In some embodiments, the antisense strand comprises the sequence of any one of SEQ ID NOs: 2437-2447.

In some embodiments, the antisense strand comprises a modification pattern according to $Nfs_a(nNf)_bns_cn$, wherein n is a 2'-O-methyl-nucleoside-3'-phosphate; Nfs is a 2'-deoxy-2'-fluoro-nucleoside-3'-phosphorothioate; Nf is a 2'-deoxy-2'-fluoro-nucleoside-3'-phosphate; and ns is a 2'-O-methyl-nucleoside-3'-phosphorothioate; and wherein a is at least 1, b is 5-10, and c is at least 1, and the sense strand comprises a modification pattern according to $ns_d(Nfn)_eNf$, wherein n is a 2'-O-methyl-nucleoside-3'-phosphate; Nf is a 2'-deoxy-2'-fluoro-nucleoside-3'-phosphate; and ns is a 2'-O-methyl-nucleoside-3'-phosphorothioate; and wherein d is at least 1, and e is 5-10. In some embodiments, the antisense strand comprises a nucleotide sequence according to any one of SEQ ID NOs: 607-1212 or 1819-2424. In some embodiments, the sense strand comprises a nucleotide sequence according to any one of SEQ ID NOs: 1-606 or 1213-1818. In some embodiments, the antisense strand comprises a nucleotide sequence according to any one of SEQ ID NOs: 2437-2447. In some embodiments, the sense strand comprises a nucleotide sequence according to any one of SEQ ID NOs: 2426-2436.

In some embodiments, any one of the RNAi agents disclosed herein comprises a modification pattern wherein the antisense strand comprises the motif F(SF)nSnn, wherein n is from 2 to about 20, nn is 0 or 1, one of F and S is a 2'-deoxy-2'-fluoro modified nucleoside and the other of F and S is a 2'-O-methyl modified nucleoside. In some embodiments, each of the antisense and the sense strand is 17-23 nucleotides in length. In some embodiments, the antisense strand corresponds to the unmodified nucleobase sequence according to any one of SEQ ID NOs: 607-1212. In some embodiments, the sense strand corresponds to the unmodified nucleobase sequence according to any one of SEQ ID NOs: 1-606. In some embodiments, the antisense strand corresponds to the unmodified antisense strand sequence in Table 1F. In some embodiments, the sense strand corresponds to the unmodified sense strand sequence in Table 1F.

In some embodiments, any one of the RNAi agents disclosed herein comprises a modification pattern wherein the antisense strand comprises the chemical modification pattern of nNfnnnNfnNfNfnnnnNfnNfnnnnn and the sense strand comprises the chemical modification nnnnnnNfnNfNfNfnnnnnnnnn, wherein n is a 2'-O-methyl-nucleoside and Nf is a 2'-deoxy-2'-fluoro-nucleoside. In some embodiments, the antisense strand corresponds to the unmodified nucleobase sequence according to any one of SEQ ID NOs: 607-1212. In some embodiments, the sense strand corresponds to the unmodified nucleobase sequence of any one according to SEQ ID NOs: 1-606. In some embodiments, the antisense strand corresponds to the unmodified antisense strand in Table 1F. In some embodiments, the sense strand corresponds to the unmodified sense strand in Table 1F.

In some embodiments, any one of the RNAi agents disclosed herein comprises a modification pattern wherein the antisense strand comprises a region having the formula X1-Y—X2, wherein Y is a subregion of from about 5 to about 12 linked nucleosides and each of X1 subregion and X2 subregion is, independently, a plurality of linked nucleosides having the formula FSFS, where one of F and S is a 2'-deoxy-2'-fluoro modified nucleoside and the other of F and S is a 2'-O-methyl modified nucleoside; and each internucleoside linkage of said X1 subregion and X2 subregion is, independently, a phosphodiester or a phosphorothioate internucleoside linkage. In some embodiments, each of the antisense and the sense strand is 20-23 nucleotides in length. In some embodiments, the antisense strand corresponds to the unmodified nucleobase sequence according to any one of SEQ ID NOs: 607-1212. In some embodiments, the sense strand corresponds to the unmodified nucleobase sequence according to any one of SEQ ID NOs: 1-606. In some embodiments, the antisense strand corresponds to the unmodified antisense strand in Table 1F. In some embodiments, the sense strand corresponds to the unmodified sense strand in Table 1F.

In some embodiments, any one of the RNAi agents disclosed herein comprises a modification pattern wherein the antisense strand comprises a contiguous sequence of linked nucleosides that define an alternating motif of the formula: 5'-Q(-L-Z-L-Q)n(-L-Z)nn-3', wherein: each L is an internucleoside linking group; either each Q is a 2'-deoxy-2'-fluoro nucleoside and each Z is a 2'-O-methyl nucleoside; or each Q is a 2'-O-methyl nucleoside and each Z is a 2'-deoxy-2'-fluoro nucleoside; and n is from 8 to 14 and nn is 0 or 1. In some embodiments, the antisense strand corresponds to the unmodified nucleobase sequence according to any one of SEQ ID NOs: 607-1212.

In some embodiments, any one of the RNAi agents disclosed herein comprises a modification pattern wherein the antisense strand is represented by the formula:

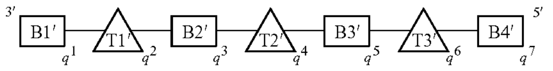

wherein, B1', B2', B3', and B4' each independently represent a nucleotide containing a modification selected from the group consisting of 2'-O-alkyl, 2'-substituted alkoxy, 2'-substituted alkyl, 2'-halo, ENA, and BNA/LNA; T1', T2', and T3' each independently represent a nucleotide comprising a chemical modification selected from the group consisting of DNA, RNA, LNA, 2'-deoxy-2'-fluoronucleotide, and 5'-(S)-methyl2'-deoxy-2'-fluoronucleotide; q1 is 4 to 15 nucleotides in length; q3 or q7 is independently 1-6 nucleotide(s) in length; q2 or q6 is independently 1-3 nucleotide(s) in length; q4 is 0-3 nucleotide(s) in length; and q5 is 0-10 nucleotide(s) in length; and wherein: the antisense strand has 2'-deoxy-2'-fluoro modifications, and wherein the 2'-deoxy-2'-fluoro modifications on the antisense strand consist of four, and only four, 2'-deoxy-2'-fluoro modifications or six, and only six, 2'-deoxy-2'-fluoro modifications. In some embodiments, the antisense strand is 19-25 nucleotides in length. In some embodiments, the antisense strand corresponds to the unmodified nucleobase sequence according to any one of SEQ ID NOs: 607-1212. In some embodiments, the sense strand corresponds to the unmodified nucleobase sequence according to any one of SEQ ID NOs: 1-606. In some embodiments, the antisense strand corresponds to the unmodified antisense strand in Table 1F. In some embodiments, the sense strand corresponds to the unmodified sense strand in Table 1F.

In some embodiments, any one of the RNAi agents disclosed herein comprises a modification pattern wherein the antisense strand and the sense strand are represented by the formula:

(I

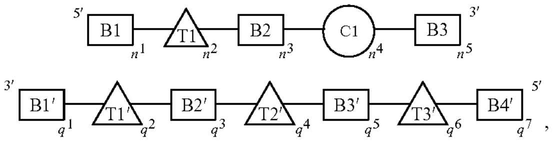

, wherein B1, B1', B2', B3', and B4' each independently represent a nucleotide containing a modification selected from the group consisting of 2'-O-alkyl, 2'-substituted alkoxy, 2'-substituted alkyl, 2'-halo, ENA, and BNA/LNA; C1 is a thermally destabilizing nucleotide, selected from the group consisting of i) a nucleotide that forms a mismatch pair with the opposing nucleotide in the antisense strand, ii) a nucleotide having an abasic modification, and iii) a nucleotide having a sugar modification, and placed at a site opposite to the seed region (positions 2-8) of the antisense strand; T1', T2', and T3' each independently represent a nucleotide comprising a modification providing the nucleotide a steric bulk that is less than or equal to the steric bulk of a 2'-OMe modification, wherein the modification is at the 2'-position of a ribose sugar of the nucleotide or at a position of a non-ribose nucleotide similar to the 2'-position of a ribose sugar; each n1, and q1 is independently 4 to 15 nucleotides in length; each q3, and q7 is independently 1-6 nucleotide (s) in length; each q2 and q6 is independently 1-3 nucleotide(s) in length; q5 is 0-10 nucleotide(s) in length; each n4, and q4 is independently 0-3 nucleotide (s) in length; n2 is 3 nucleotides in length, and T1 each are 2'-deoxy-2'-fluoronucleotides; n3 is 7 nucleotides in length, and B2 each are 2'-OMe nucleotides; and n5 is 3 nucleotides in length, and B3 each are 2'-OMe nucleotides. In some embodiments, wherein the antisense strand and sense strand are each 14 to 40 nucleotides. In some embodiments, the antisense strand corresponds to the unmodified nucleobase sequence according to any one of SEQ ID NOs: 607-1212. In some embodiments, the sense strand corresponds to the unmodified nucleobase sequence according to any one of SEQ ID NOs: 1-606. In some embodiments, the antisense strand corresponds to the unmodified antisense strand in Table 1F. In some embodiments, the sense strand corresponds to the unmodified sense strand in Table 1F.

In some embodiments, any one of the RNAi agents disclosed herein comprises a modification pattern wherein the antisense strand is represented by the formula:

(Is)

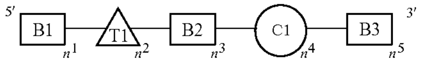

wherein: B1, B2, and B3 each independently represent a nucleotide containing a modification selected from the group consisting of 2'-O-alkyl, 2'-substituted alkoxy, 2'-substituted alkyl, 2'-halo, ENA, and BNA/LNA; C1 is a thermally destabilizing nucleotide, selected from the group consisting of i) a nucleotide that forms a mismatch pair with the opposing nucleotide in the antisense strand, ii) a nucleotide having an abasic modification, and iii) a nucleotide having a sugar modification, and placed at a site opposite to the seed region (positions 2-8) of the antisense strand; T1 represents a nucleotide comprising a 2'-deoxy-2'-fluoro modification; n1 or n3 is independently 4 to 15 nucleotides in length; n5 is 1-6 nucleotide(s) in length; n2 is 3; n4 is 0-3 nucleotide(s) in length; and wherein the sense strand has 2'-deoxy-2'-fluoro modifications, and wherein the 2'-deoxy-2'-fluoro modifications on the sense strand consist of four, and only four, 2'-deoxy-2'-fluoro modifications, wherein the four 2'-deoxy-2'-fluoro modifications are at positions 7 and 9-11 from the 5'-end of the sense strand. In some embodiments, wherein the antisense strand and sense strand are each 19-25 nucleotides. In some embodiments, the antisense strand corresponds to the unmodified nucleobase sequence according to any one of SEQ ID NOs: 607-1212. In some embodiments, the sense strand corresponds to the unmodified nucleobase sequence according to any one of SEQ ID NOs: 1-606. In some embodiments, the antisense strand corresponds to the unmodified antisense strand in Table 1F. In some embodiments, the sense strand corresponds to the unmodified sense strand in Table 1F.

In some embodiments, any one of the RNAi agents disclosed herein comprises a modification pattern wherein the antisense strand is complementary to at least one portion of a mRNA of the target gene (e.g., DUX4), wherein the oligonucleotide is represented by the formula:

(I)

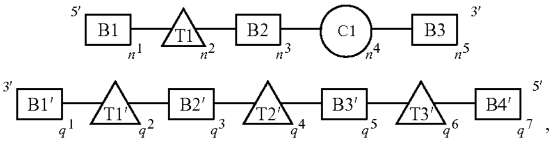

wherein: B1', B2', B3', and B4' each independently represent a nucleotide containing a modification selected from the group consisting of 2'-O-methyl and 2'-deoxy-2'-fluoro; each B1, B2, and B3 is 2'-OMe; C1 is glycerol nucleic acid (GNA) placed at a site opposite to the seed region (positions 2-8) of the antisense strand; T1', T2', and T3' are each 2'-deoxy-2'-fluoronucleotides, wherein: T1' is at position 14 from the 5' end of the antisense strand, and q2 is 1; and T3' is at position 2 from the 5' end of the antisense strand, and q6 and q7 are 1; each n1, n3, and q1 is independently 4 to 15 nucleotides in length; each n5 and q3 is independently 1-6 nucleotide(s) in length; q5 is 0-10 nucleotide(s) in length; each n4 and q4 is independently 0-3 nucleotide (s) in length; n2 is 3 nucleotides in length, and T1 each are 2'-deoxy-2'-fluoro nucleotides, and wherein (a) the oligonucleotide is covalently conjugated to at least one ligand; and (b) one of the T1 nucleotides is at position 11 from the 5' end of the sense strand. In some embodiments, the sense strand comprises 19-22 nucleotides and the antisense strand comprises 19-25 nucleotides. In some embodiments, the antisense strand corresponds to the unmodified nucleobase sequence according to any one of SEQ ID NOs: 607-1212. In some embodiments, the sense strand corresponds to the unmodified nucleobase sequence according to any one of SEQ ID NOs: 1-606. In some embodiments, the antisense strand corresponds to the unmodified antisense strand in Table 1F. In some embodiments, the sense strand corresponds to the unmodified sense strand in Table 1F.

In some embodiments, any one of the RNAi agents disclosed herein comprises a modification pattern wherein the oligonucleotide is represented by the formula:

(I)

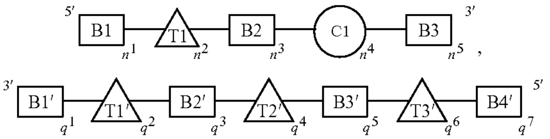

wherein B1', B2', B3', and B4' each independently represent a nucleotide containing a modification selected from the group consisting of 2'-O-methyl and 2'-deoxy-2'-fluoro; each B1, B2, and B3 is 2'-Ome nucleotides; C1 is glycerol nucleic acid (GNA) placed at a site opposite to the seed region (positions 2-8) of the antisense strand; T1', T2', and T3' are each 2'-deoxy-2'-fluoro nucleotides, wherein: T1' is at position 14 from the 5' end of the antisense strand, and q2 is 1; and T3' is at position 2 from the 5' end of the antisense strand, and q6 and q7 are 1; each n1, n3, and q1 is independently 4 to 15 nucleotides in length; each n5 and q3 is independently 1-6 nucleotide(s) in length; q5 is 0-10 nucleotide(s) in length; each n4 and q4 is independently 0-3 nucleotide(s) in length; n2 is 3 nucleotides in length, and T1 each are 2'-deoxy-2'-fluoro nucleotides, and wherein (a) the oligonucleotide is covalently conjugated to at least one ligand; and (b) one of the T1 nucleotides is at a position in the sense strand that is opposite to position 11 from the 5' end of the antisense strand; and (c) the oligonucleotide comprises at least one phosphorothioate internucleoside linkage. In some embodiments, the sense strand comprises 19-22 nucleotides and the antisense strand comprises 19-25 nucleotides. In some embodiments, the antisense strand corresponds to the unmodified nucleobase sequence according to any one of SEQ ID NOs: 607-1212. In some embodiments, the sense strand corresponds to the unmodified nucleobase sequence according to any one of SEQ ID NOs: 1-606. In some embodiments, the antisense strand corresponds to the unmodified antisense strand in Table 1F. In some embodiments, the sense strand corresponds to the unmodified sense strand in Table 1F.

In some embodiments, any one of the RNAi agents disclosed herein comprises a modification pattern wherein the antisense strand has sufficient complementarity to a target sequence to mediate RNA interference, wherein said sense strand comprises at least one thermally destabilizing modification of the duplex within the first 9 nucleotide positions of the 5' region of the antisense strand or a precursor thereof, wherein the antisense strand further comprises one or both of the following characteristics: (i) 2, 3, 4, 5 or 6 2'-deoxy-2'-fluoro modifications; and (ii) 1, 2, 3, 4 or 5 phosphorothioate internucleoside linkages; and said sense strand comprises one or both of the following characteristics: (iii) 2, 3, 4, or 5 2'-deoxy-2'-fluoro modifications; and (iv) 1, 2, 3, 4 or 5 phosphorothioate internucleoside linkages. In some embodiments, the antisense strand and sense strand are each 14 to 40 nucleotides. In some embodiments, the antisense strand corresponds to the unmodified nucleobase sequence according to any one of SEQ ID NOs: 607-1212. In some embodiments, the sense strand corresponds to the unmodified nucleobase sequence according to any one of SEQ ID NOs: 1-606. In some embodiments, the antisense strand corresponds to the unmodified antisense strand in Table 1F. In some embodiments, the sense strand corresponds to the unmodified sense strand in Table 1F.

Synthesis, Purification, and Analysis of the Oligonucleotides Described Herein

Oligomer synthesis of modified and unmodified nucleosides and nucleotides can be routinely performed according to literature procedures for DNA (Protocols for Oligonucleotides and Analogs, Ed. Agrawal (1993), Humana Press) and/or RNA (Scaringe, Methods (2001), 23, 206-217. Gait et al., Applications of Chemically synthesized RNA in RNA: Protein Interactions, Ed. Smith (1998), 1-36. Gallo et al., Tetrahedron (2001), 57, 5707-5713). The oligonucleotides provided herein can be conveniently and routinely made through the well-known technique of solid phase synthesis. Equipment for such synthesis is sold by several vendors including, for example, LGC (Alexandria, MN). Any other means for such synthesis known in the art may additionally or alternatively be employed. It is well known to use similar techniques to prepare oligonucleotides such as the phosphorothioates and alkylated derivatives. Methods of purification and analysis of oligomeric compounds are known to those skilled in the art. Analysis methods include capillary electrophoresis (CE), reverse-phase high performance liquid chromatography (RP-HPLC), and electrospray-mass spectroscopy (ESI-MS). Such synthesis and analysis methods can be performed in multi-well plates. The oligonucleotides of the invention can be prepared using solution-phase or solid-phase organic synthesis, or enzymatically by methods known in the art. Organic synthesis offers the advantage that the oligomeric strands comprising non-natural or modified nucleotides can be easily prepared. Any other means for such synthesis known in the art can additionally or alternatively be employed. It is also known to use similar techniques to prepare other oligonucleotides, such as those comprising phosphorothioates, phosphorodithioates and alkylated derivatives of internucleoside linkages. The double-stranded oligonucleotides of the invention can be prepared using a two-step procedure. First, the individual strands of the double-stranded oligonucleotides are prepared separately. Then, the component strands are annealed. Regardless of the method of synthesis, the oligonucleotides can be prepared in a solution (e.g., an aqueous and/or organic solution) that is appropriate for formulation. For example, the oligonucleotides preparation can be precipitated and redissolved in pure double-distilled water, and lyophilized. The dried oligonucleotides can then be resuspended in a solution appropriate for the intended formulation process. Teachings regarding the synthesis of particular modified oligonucleotides can be found in the following U.S. patents or pending patent applications. U.S. Pat. Nos. 5,138,045 and 5,218,105, drawn to polyamine conjugated oligonucleotides; U.S. Pat. No. 5,212,295, drawn to monomers for the preparation of oligonucleotides having chiral phosphorus linkages; U.S. Pat. Nos. 5,378,825 and 5,541,307, drawn to oligonucleotides having modified backbones; U.S. Pat. No. 5,386,023, drawn to backbone-modified oligonucleotides and the preparation thereof through reductive coupling; U.S. Pat. No. 5,457,191, drawn to modified nucleobases based on the 3-deazapurine ring system and methods of synthesis thereof, U.S. Pat. No. 5,459,255, drawn to modified nucleobases based on N-2 substituted purines; U.S. Pat. No. 5,521,302, drawn to processes for preparing oligonucleotides having chiral phosphorus linkages; U.S. Pat. No. 5,539,082, drawn to peptide nucleic acids; U.S. Pat. No. 5,554,746, drawn to oligonucleotides having beta-lactam backbones; U.S. Pat. No. 5,571,902, drawn to methods and materials for the synthesis of oligonucleotides; U.S. Pat. No. 5,578,718, drawn to nucleosides having alkylthio groups, wherein such groups can be used as linkers to other moieties attached at any of a variety of positions of the nucleoside; U.S. Pat. Nos. 5,587,361 and 5,599,797, drawn to oligonucleotides having phosphorothioate linkages of high chiral purity; U.S. Pat. No. 5,506,351, drawn to processes for the preparation of 2'-O-alkyl guanosine and related compounds, including 2,6-diaminopurine compounds; U.S. Pat. No. 5,587,469, drawn to oligonucleotides having N-2 substituted purines; U.S. Pat. No. 5,587,470, drawn to oligonucleotides having 3-deazapurines; U.S. Pat. Nos. 5,223,168, and 5,608,046, both drawn to conjugated 4'-desmethyl nucleoside analogs; U.S. Pat. Nos. 5,602,240, and 5,610,289, drawn to backbone-modified oligonucleotide analogs; and U.S. Pat. Nos. 6,262,241, and 5,459,255, drawn to, inter alia, methods of synthesizing 2'-deoxy-2'-fluoro-oligonucleotides. In some embodiments, the oligonucleotides described herein are chemically synthesized using a phosphoramidite approach, e.g., the method by Roy et al. Molecules. 2013; 18(11): 14268-14284; Hayakawa et al. Journal of the American Chemical Society. 1998; 120(48):12395-401; Beaucage, S. L. (1993). Oligodeoxyribonucleotides synthesis: Phosphoramidite approach. In Protocols for Oligonucleotides and Analogs: Synthesis and Properties (pp. 33-61). Humana Press, each of which is hereby incorporated by reference.

Pharmaceutical Compositions

The present disclosure also includes pharmaceutical compositions and formulations comprising the oligonucleotides (e.g., an RNAi agent or ASO) described herein, or a pharmaceutically acceptable salt thereof. In one embodiment, provided herein are pharmaceutical compositions comprising an oligonucleotide (e.g., an RNAi agent or ASO), as described herein, or a pharmaceutically acceptable salt thereof, and a pharmaceutically acceptable carrier or excipient. The pharmaceutical compositions comprising the oligonucleotides described herein are useful for treating or preventing a condition or symptoms associated with DUX4 expression. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. In some embodiments, an oligonucleotide is formulated in buffer solutions such as phosphate-buffered saline solutions, liposomes, micellar structures, and capsids. In some embodiments, naked oligonucleotides or conjugates thereof are formulated in water or in an aqueous solution (e.g., water with pH adjustments). In some embodiments, naked oligonucleotides or conjugates thereof are formulated in basic buffered aqueous solutions (e.g., PBS). The pharmaceutical compositions of the invention may be administered in dosages sufficient to inhibit expression of the target gene.

A "pharmaceutically acceptable carrier or excipient" is a pharmaceutically acceptable solvent, suspending agent, or any other pharmacologically inert vehicle for delivering one or more oligonucleotides to a subject. The excipient can be liquid or solid and is selected, with the planned manner of administration in mind, so as to provide for the desired bulk, consistency, etc., when combined with the oligonucleotide and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc.).

In some embodiments, the present disclosure also includes a pharmaceutical composition suitable for injectable use, which comprises sterile aqueous solutions (where water soluble) or dispersions and sterile powders for the extemporaneous preparation of sterile injectable solutions or dispersions. For intravenous or subcutaneous administration, suitable carriers include physiological saline, bacteriostatic water, Cremophor EL® (BASF, Parsippany, N.J.) or phosphate buffered saline (PBS). The carrier can be a solvent or dispersion medium containing, for example, water, ethanol, polyol (for example, glycerol, propylene glycol, and liquid polyethylene glycol, and the like), and suitable mixtures thereof. In many cases, it will be preferable to include isotonic agents, for example, sugars, polyalcohols such as mannitol, sorbitol, and sodium chloride in the composition. Sterile injectable solutions can be prepared by incorporating the oligonucleotides in a required amount in a selected solvent with one or a combination of ingredients enumerated above, as required, followed by filtered sterilization.

Formulations for topical administration of oligonucleotides can include sterile and non-sterile aqueous solutions, non-aqueous solutions in common solvents such as alcohols, or solutions of the oligonucleotides in liquid or solid oil bases. The solutions can also contain buffers, diluents and other suitable additives. Pharmaceutically acceptable organic or inorganic excipients suitable for non-parenteral administration which do not deleteriously react with nucleic acids can also be used to formulate the compositions of the present disclosure. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

In some embodiments, the oligonucleotides herein are conjugated to one or more non-nucleotide groups including, but not limited to, a targeting group/targeting moiety, linking group, delivery polymer, or a delivery vehicle. The non-nucleotide group can enhance targeting, delivery, or attachment of the oligonucleotide.

In some embodiments, at least one nucleotide of the oligonucleotide herein is conjugated to one or more targeting ligands, such as a carbohydrate, amino sugar, cholesterol, polypeptide, or lipid. Exemplary targeting ligands include, but are not limited to, thyrotropin, melanotropin, lectin, a glycoprotein, surfactant protein A, mucin carbohydrate, a multivalent lactose moiety, a multivalent galactose moiety, a N-acetylgalactosamine (GalNAc) moiety, a N-acetyl-glucosamine moiety, a multivalent mannose moiety, a multivalent fucose moiety, a glycosylated polypeptide, transferrin or an antibody, antibody fragment, protein, peptide, or aptamer capable of binding the transferrin receptor, bisphosphonate, polyglutamate, polyaspartate, cholesterol, bile acid, folate, vitamin B12, biotin, an RGD peptide, or an RGD peptide mimetic. In some embodiments, the targeting ligand comprises a N-acetylgalactosamine (GalNAc) moiety. In some embodiments, the GalNAc moiety comprises a monovalent GalNAc moiety, a bivalent GalNAc moiety, a trivalent GalNAc moiety, or a tetravalent GalNAc moiety.

The non-nucleotide group can be covalently linked to the 3' and/or 5' end of either the antisense strand and/or the sense strand, when present. In some embodiments, when the oligonucleotide is an RNAi agent, the RNAi agent contains a non-nucleotide group linked to the 3' and/or 5' end of the sense strand. In some embodiments, a non-nucleotide group is linked to the 5' end of a DUX4 RNAi agent sense strand. A non-nucleotide group may be linked directly or indirectly to the oligonucleotide via a linker/linking group. In some embodiments, a non-nucleotide group is linked to the oligonucleotide via a labile, cleavable, or reversible bond or linker.

In some embodiments, the targeting moiety is a targeting ligand. In some embodiments, the targeting ligand is small molecule-based, sugar-based (e.g., saccharide-based), fatty acid-based, protein-based, or nucleic acid-based targeting ligand. In some embodiments, the targeting moiety is a protein-based targeting ligand. In some embodiments, the protein-based targeting ligand is an antibody, nanobody, affibody, a peptibody, or a peptide. In some embodiments, the protein-based targeting ligand is an antibody, a functional fragment thereof, or an antigen-binding fragment thereof.

Various formulations have been developed to facilitate oligonucleotide use. For example, oligonucleotides can be delivered to a subject or a cellular environment using a formulation that minimizes degradation, facilitates delivery and/or uptake, or provides another beneficial property to the oligonucleotides in the formulation. In some embodiments, an oligonucleotide herein is formulated in buffer solutions such as phosphate buffered saline solutions, liposomes, micellar structures and capsids. Formulations of oligonucleotides with cationic lipids can be used to facilitate transfection of the oligonucleotides into cells. For example, cationic lipids, such as lipofectin, cationic glycerol derivatives, and polycationic molecules (e.g., polylysine), can be used. Suitable lipids include Oligofectamine, Lipofectamine (Life Technologies), NC388 (Ribozyme Pharmaceuticals, Inc., Boulder, Colo.), or FuGene 6 (Roche), all of which can be used according to the manufacturer's instructions. Accordingly, in some embodiments, a formulation herein comprises a lipid nanoparticle. In some embodiments, an excipient comprises a liposome, a lipid, a lipid complex, a microsphere, a microparticle, a nanosphere or a nanoparticle, or may be otherwise formulated for administration to the cells, tissues, organs, or body of a subject in need thereof (see, e.g., Remington: THE SCIENCE AND PRACTICE OF PHARMACY, 22nd edition, Pharmaceutical Press, 2013). In some embodiments, the formulations herein comprise an excipient. In some embodiments, an excipient confers to a composition improved stability, improved absorption, improved solubility and/or therapeutic enhancement of the active ingredient. In some embodiments, an excipient is a buffering agent (e.g., sodium citrate, sodium phosphate, a tris base, or sodium hydroxide) or a vehicle (e.g., a buffered solution, petrolatum, dimethylsulfoxide or mineral oil). In some embodiments, an oligonucleotide is lyophilized for extending its shelf-life and then made into a solution before use (e.g., administration to a subject). Accordingly, an excipient in a composition comprising any one of the oligonucleotides described herein may be a lyoprotectant (e.g., mannitol, lactose, polyethylene glycol or polyvinylpyrrolidone) or a collapse temperature modifier (e.g., dextran, Ficoll® or gelatin).

Methods of Treatment

The present disclosure also provides methods of using any one of the oligonucleotides disclosed herein, or a pharmaceutically acceptable salt thereof, or any one of the pharmaceutical compositions as described herein, to reduce or inhibit DUX4 expression in a subject. The methods include contacting one or more cells in a subject with an oligonucleotide of the disclosure, or a pharmaceutically acceptable salt thereof, or any one of the pharmaceutical compositions as described herein, thereby inhibiting expression of DUX4 in the cells. The present disclosure also provides use of any one of the oligonucleotides disclosed herein, or a pharmaceutically acceptable salt thereof, or any one of the pharmaceutical compositions as described herein, in the manufacture of a medicament for reducing or inhibiting DUX4 expression in a subject, or for preventing or treating a DUX4 related disorder in a subject. In some embodiments, the terms "inhibiting DUX4 expression" and "reducing DUX4 expression" are interchangeable.

Reduction in DUX4 expression can be assessed by any methods known in the art. For example, a reduction in the expression of DUX4 may be determined by determining the mRNA expression level of DUX4 or a panel of its targets using methods routine to one of ordinary skill in the art, e.g., northern blotting, qRT-PCR; by determining the protein level of DUX4 using methods routine to one of ordinary skill in the art, such as western blotting, immunological techniques.

In some embodiments, the reduction of DUX4 expression is determined by measuring DUX4 expression or a panel of its targets in a population of muscle cells derived from the subject. In some embodiments, reduction in DUX4 expression is assessed by determining the mRNA expression level of a panel of DUX4's targets, e.g., a panel comprising one or more of LEUTX, TRIM43, KHDC1L, MBD3L2, CCNA1, ZSCAN4, SLC34A2, or PRAMEF6. In some embodiments, reduction in DUX4 expression is assessed by determining the mRNA expression level of a panel of DUX4's targets, e.g., a panel comprising one or more of CCNA1, SLC34A2, ZSCAN4, PRAMEF2, PRAMEF17, PRAMEF12, LEUTX, HNRNPCL1, RFPL4B, PRAMEF1, PRAMEF19, TRIM43B, TRIM43, PRAMEF14, PRAMEF11, KDM4E, RFPL2, PRAMEF15, PRAMEF6, ZNF280A, PRAMEF9, TRIM49, KHDC1P1, PRAMEF4, TPRX1, TRIM49B, TRIM51CP, KLF17, TRIM51BP, TRIM53CP, C1DP2, TRIM53AP, TRIM51, PRAMEF8, MBD3L2B, KHDC1L, ALPG, TRIM49C, MBD3L2, ZNF705G, MBD3L3, PRAMEF7, TRIM43CP, PRAMEF1O, HNRNPCL4, TRIM53BP, TRIM51EP, or MBD3L5. In some embodiments, the reduction in DUX4 expression is assessed by determining the mRNA expression level of a panel of DUX4's targets, e.g., a DUX4 panel comprising one or more of KHDC1L, LEUTX, MBD3L2, and ZSCAN4. In some embodiments, the reduction of DUX4 expression is assessed by determining the mRNA or protein expression of one or more circulating DUX4 targets (e.g., KHDC1L).

In some embodiments, the reduction of DUX4 expression is determined by measuring mRNA expression of DUX4 or its targets in a population of cancer cells derived from the subject. In some embodiments, the cancer cells are primary cancer cells or metastatic cancer cells. In some embodiments, the cancer cells are selected from malignant B cells, melanoma cancer cells, breast cancer cells, kidney cancer cells, bladder cancer cells, and prostate cancer cells. In some embodiments, the subject has one or more DUX4 related conditions selected from Capicua transcriptional repressor (CIC)-rearranged sarcoma, undifferentiated round cell sarcoma, embryonal rhabdomyosarcoma (ERMS), acute myeloid leukemia (AML; e.g., erythromegakaryoblastic leukemia), B-cell acute lymphoblastic leukemia (B-ALL), cutaneous melanoma, breast invasive carcinoma, renal clear cell carcinoma, urothelial carcinoma, prostate adenocarcinoma, adrenocortical carcinoma, cervical squamous cell carcinoma, endocervical adenocarcinoma, cholangiocarcinoma, colon adenocarcinoma, lymphoid neoplasm diffuse large B-cell lymphoma, esophageal carcinoma, glioblastoma multiforme, head and neck squamous cell carcinoma, kidney chromophobe, kidney renal papillary cell carcinoma, acute myeloid leukemia, brain lower grade glioma, liver hepatocellular carcinoma, lung adenocarcinoma, lung squamous cell carcinoma, mesothelioma, ovarian serous cystadenocarcinoma, pancreatic adenocarcinoma, pancreatic ductal adenocarcinoma, pheochromocytoma, paraganglioma, rectum adenocarcinoma, sarcoma, stomach adenocarcinoma, testicular germ cell tumors, thyroid carcinoma, thymoma, uterine corpus endometrial carcinoma, uterine carcinosarcoma, and uveal melanoma.

In some embodiments, the reduction of DUX4 expression is determined by measuring mRNA expression of DUX4 or its targets in a population of cells derived from a subject. In some embodiments, the subject is affected by viral infections caused by viruses such as herpesviruses (e.g., HSV-1, HSV-2, cytomegalovirus (HCMV)).

In some embodiments, the reduction of DUX4 mRNA or protein expression levels is measured in tissues derived from the subject. In some embodiments, the reduction of DUX4 mRNA or protein expression levels is determined by measuring the mRNA or protein expression levels of DUX4 biomarkers (e.g., one or more of the DUX4's targets described herein) in serum derived from the subject.

The present disclosure further provides methods of treatment of a subject in need thereof. The methods of treatment include administering an oligonucleotide of the disclosure to a subject, e.g., a subject that would benefit from inhibition of DUX4 expression, in a therapeutically effective amount of an oligonucleotide targeting a DUX4 gene or a pharmaceutical composition comprising an oligonucleotide targeting a DUX4 gene.

The in vivo methods of the disclosure may include administering to a subject a composition containing an oligonucleotide disclosed herein, or a pharmaceutically acceptable salt, wherein the oligonucleotide includes a nucleotide sequence that is complementary to at least a part of a sequence of nucleotides encoding DUX4 of the subject to be treated.

The oligonucleotide can be administered by any means known in the art including, but not limited to, oral, intraperitoneal, or parenteral routes, including intracranial (e.g., intraventricular, intraparenchymal, and intrathecal), intravenous, intramuscular, intravitreal, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intrathecal injection. The administration of the oligonucleotide may be repeated over a period of time. The administration may be repeated on a regular basis. In some embodiments, after an initial treatment regimen, the treatments can be administered on a less frequent basis. A repeat-dose regimen may include administration of a therapeutic amount of an oligonucleotide on a regular basis.

The present disclosure also provides methods of using any one of the oligonucleotides disclosed herein, or a pharmaceutically acceptable salt thereof, to treat or prevent a DUX4-related disorder in a subject. The present disclosure also provides a method for inhibiting DUX4 expression or treating a DUX4 related disorder in a subject, the method comprising administering to the subject an effective amount of an oligonucleotide for inhibiting expression of DUX4, or a pharmaceutically acceptable salt thereof, or a pharmaceutical composition comprising the oligonucleotide for inhibiting expression of DUX4. Non-limiting examples of DUX4 related disorders include facioscapulohumeral muscular dystrophy (FSHD; e.g., FSHD1 and FSHD2), DUX4-related cancers such as Capicua transcriptional repressor (CIC)-rearranged sarcoma, undifferentiated round cell sarcoma, embryonal rhabdomyosarcoma (ERMS), acute myeloid leukemia (AML; e.g., erythromegakaryoblastic leukemia), B-cell acute lymphoblastic leukemia (B-ALL), cutaneous melanoma, breast invasive carcinoma, renal clear cell carcinoma, urothelial carcinoma, prostate adenocarcinoma, adrenocortical carcinoma, cervical squamous cell carcinoma, endocervical adenocarcinoma, cholangiocarcinoma, colon adenocarcinoma, lymphoid neoplasm diffuse large B-cell lymphoma, esophageal carcinoma, glioblastoma multiforme, head and neck squamous cell carcinoma, kidney chromophobe, kidney renal papillary cell carcinoma, acute myeloid leukemia, brain lower grade glioma, liver hepatocellular carcinoma, lung adenocarcinoma, lung squamous cell carcinoma, mesothelioma, ovarian serous cystadenocarcinoma, pancreatic adenocarcinoma, pancreatic ductal adenocarcinoma, pheochromocytoma, paraganglioma, rectum adenocarcinoma, sarcoma, stomach adenocarcinoma, testicular germ cell tumors, thyroid carcinoma, thymoma, uterine corpus endometrial carcinoma, uterine carcinosarcoma, and uveal melanoma; and DUX4-mediated viral diseases caused by viruses such as herpesviruses (e.g., HSV-1, HSV-2, cytomegalovirus (HCMV)). In some embodiments, the DUX4-related disorder is facioscapulohumeral muscular dystrophy (FSHD), a DUX4-related cancer, or a DUX4-medicated viral disease. In some embodiments, the DUX4-related disorder is facioscapulohumeral muscular dystrophy (FSHD). In some embodiments, the DUX4-related disorder is a DUX4-related cancer such as Capicua transcriptional repressor (CIC)-rearranged sarcoma. In some embodiments, the DUX4-related disorder is a DUX4-mediated viral disease, such as herpes viral infection caused by HSV-1, HSV-2, or cytomegalovirus (HCMV).

In some embodiments, the present disclosure provides a method of treating facioscapulohumeral muscular dystrophy (FSHD), comprising administering an oligonucleotide disclosed herein, or a pharmaceutically acceptable salt thereof, to a subject in need thereof.

In some embodiments, the present disclosure provides a method of treating Capicua transcriptional repressor (CIC)-rearranged sarcoma, comprising administering an oligonucleotide disclosed herein, or a pharmaceutically acceptable salt thereof, to a subject in need thereof.

In some embodiments, the present disclosure provides a method of treating herpes viral infection, comprising administering an oligonucleotide disclosed herein, or a pharmaceutically acceptable salt thereof, to a subject in need thereof.

An oligonucleotide of the disclosure may be administered as a "free oligonucleotide." A free oligonucleotide is administered in the absence of a transfection agent. The naked oligonucleotide may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the oligonucleotide can be adjusted such that it is suitable for administering to a subject. Alternatively, an RNAi agent of the disclosure may be administered as a pharmaceutical composition, such as a dsRNA liposomal formulation.

In some embodiments, the methods herein may further comprise administering to the subject an additional agent or therapy suitable for treatment or prevention of a DUX4 related disorder. Non-limiting examples of such additional agents or therapies include anti-ACVR2B antibodies, beta2-agonists, creatine, myostatin inhibitors, and anti-inflammatories or antioxidants such glucocorticoids and nutraceuticals.

EXEMPLARY EMBODIMENTS

Embodiment 1: An oligonucleotide for inhibiting expression of DUX4, wherein the oligonucleotide comprises an antisense strand comprising at least 14 contiguous nucleotides substantially complementary to a sequence of nucleotides encoding DUX4, with no more than 4 mismatched nucleotides.

Embodiment 2: The oligonucleotide of Embodiment 1, wherein the sequence of nucleotides encoding DUX4 comprises a nucleotide sequence having at least 90% nucleotide sequence identity to SEQ ID NO: 2425.

Embodiment 3: The oligonucleotide of Embodiment 1 or 2, wherein the oligonucleotide targets a sequence of nucleotides corresponding to positions of SEQ ID NO: 2425 selected from Table 4.

Embodiment 4: The oligonucleotide of any one of Embodiments 1-3, wherein the antisense strand is substantially or completely complementary to a sequence of nucleotides corresponding to an untranslated region of the DUX4 transcript.

Embodiment 5: The oligonucleotide of any one of Embodiments 1-4, wherein the oligonucleotide is an RNAi agent.

Embodiment 6: The oligonucleotide of Embodiment 5, wherein the oligonucleotide is a double stranded small interfering RNA, a short hairpin RNA, or a Dicer-substrate siRNA (DsiRNA).

Embodiment 7: The oligonucleotide of Embodiment 6, wherein the RNAi agent is a double-stranded small interfering RNA (siRNA) further comprising a sense strand, wherein the sense strand and antisense strand form a double stranded region.

Embodiment 8: The oligonucleotide of any one of Embodiments 1-7, wherein the antisense strand comprises a nucleotide sequence comprising at least 15 contiguous nucleotides (for example, 15, 16, 17, 18, 19, 20, or 21 contiguous nucleotides) differing by no more than 4, 3, 2, or 1 nucleotides from the nucleotide sequence of any one of SEQ ID NOs: 607-1212, 1819-2424, 2437-2447, or 3012-3602, or a nucleotide sequence having at least 90% nucleotide sequence identity to a portion of the nucleotide sequence of any one of SEQ ID NOs: 607-1212, 1819-2424, 2437-2447, or 3012-3602.

Embodiment 9: The oligonucleotide of any one of Embodiments 1-8, wherein the antisense strand comprises the nucleotide sequence of any one of SEQ ID NOs: 607-1212, 1819-2424, 2437-2447, or 3012-3602.

Embodiment 10: The oligonucleotide of any one of Embodiments 7-9, wherein the sense strand comprises a nucleotide sequence differing by no more than 4, 3, 2, or 1 nucleotides from the nucleotide sequence of any one of SEQ ID Nos: 1-606, 1213-1818, 2426-2436, or 2448-3011, or a nucleotide sequence having at least 90% nucleotide sequence identity to a portion of the nucleotide sequence of any one of SEQ ID NOs: 1-606, 1213-1818, 2426-2436, or 2448-3011.

Embodiment 11: The oligonucleotide of any one of Embodiments 7-10, wherein the sense strand comprises the nucleotide sequence of any one of SEQ ID NOs: 1-606, 1213-1818, 2426-2436, or 2448-3011.

Embodiment 12: The oligonucleotide of any one of Embodiments 7-11, wherein the antisense strand comprises a nucleotide sequence of any one of SEQ ID NOs: 607-1212, 1819-2424, 2437-2447, or 3012-3602, and the sense strand comprises a nucleotide sequence of any one of SEQ ID NOs: 1-606, 1213-1818, 2426-2436, or 2448-3011.

Embodiment 13: The oligonucleotide of any one of Embodiments 7-12, wherein each strand is no more than 30 nucleotides in length, or 19-30 nucleotides in length, or 19-23 nucleotides in length, or 19-21 nucleotides in length.

Embodiment 14: The oligonucleotide of any one of Embodiments 7-13, wherein at least one strand comprises a 3' overhang of at least 1 nucleotide or at least 2 nucleotides.

Embodiment 15: The oligonucleotide of any one of Embodiments 7-14, wherein at least one strand comprises a 5' overhang of at least 1 nucleotide or at least 2 nucleotides.

Embodiment 16: The oligonucleotide of any one of Embodiments 7-15, wherein the double stranded region is 15-30 nucleotide pairs in length, or 15-23 nucleotide pairs in length, or 17-25 nucleotide pairs in length, or 19-23 nucleotide pairs in length, or 19-21 nucleotide pairs in length.

Embodiment 17: The oligonucleotide of any one of Embodiments 7-16, wherein the antisense strand is 21 nucleotides in length and the sense strand is 19 nucleotides in length, or the antisense strand is 19 nucleotides in length and the sense strand is 19 nucleotides in length.

Embodiment 18: The oligonucleotide of any one of Embodiments 1-4, wherein the oligonucleotide is a single-stranded antisense oligonucleotide (ASO).

Embodiment 19: The oligonucleotide of Embodiment 18, wherein the ASO comprises a nucleic acid sequence comprising at least 14 contiguous nucleotides (for example, 14, 15, 16, 17, 18, 19, 20, or 21 contiguous nucleotides) that differ by no more than 1, 2, 3, or 4 nucleotides from any one of SEQ ID NOs: 607-1212 or 3012-3602.

Embodiment 20: The oligonucleotide of Embodiment 18 or 19, wherein the ASO comprises a nucleic acid sequence comprising at least 14 contiguous nucleotides (for example, 14, 15, 16, 17, 18, 19, 20, or 21 contiguous nucleotides) that differ by no more than 1, 2, 3 or 4 nucleotides from any one of SEQ ID NOs: 1819-2424 or 2437-2447.

Embodiment 21: The oligonucleotide of any one of Embodiments 1-20, wherein the oligonucleotide comprises one or more modifications.

Embodiment 22: The oligonucleotide of Embodiment 21, wherein the one or more modifications is selected from a ribose modification, a backbone modification, a nucleobase modification, or a combination thereof.

Embodiment 23: The oligonucleotide of Embodiment 22, wherein the ribose modification comprises a locked nucleic acid (LNA), a tricyclo-DNA (tcDNA), 2'-deoxy-2'-fluoro, 2'-O-methyl, 2'-methoxyethyl (2'-MOE), 2'-deoxy-2'-arabino-fluoro, 2'-O-benzyl, 2'-O-methyl-4-pyridine, 2' cyclic ethyl (cET), phosphorodiamidate morpholino (PMO), glycol nucleic acid (GNA), unlocked nucleic acid (UNA), a threose nucleic acid (TNA), or a combination thereof.

Embodiment 24: The oligonucleotide of Embodiment 23, wherein the ribose modification comprises a 2'-deoxy-2'-fluoro, 2'-O-methyl, glycol nucleic acid (GNA), unlocked nucleic acid (UNA), a threose nucleic acid (TNA), or a combination thereof.

Embodiment 25: The oligonucleotide of Embodiment 23 or 24, wherein the ribose modification is a 2'-deoxy-2'-fluoro modification, a 2'-O-methyl modification, or a combination thereof.

Embodiment 26: The oligonucleotide of any one of Embodiments 22-25, wherein the backbone modification comprises phosphorothioate, phosphorodithioate, methylphosphonate, methyoxypropyl-phosphonate, 5'-(E)-vinylphosphonate, 5'-methyl phosphonate, 5'-methyl phosphate, 5'-phosphorothioate, peptide nucleic acid (PNA), or a combination thereof.

Embodiment 27: The oligonucleotide of Embodiment 26, wherein the backbone modification comprises a phosphorothioate.

Embodiment 28: The oligonucleotide of any one of Embodiments 22-27, wherein the backbone modification comprises a phosphorothioate modification.

Embodiment 29: The oligonucleotide of any one of Embodiments 22-28, wherein the nucleobase modification comprises 5-substituted pyrimidines, 6-azapyrimidines and N-2, N-6 and 0-6 substituted purines, 5-methylcytosine (5-Me-C), 5-hydroxymethyl cytosine, xanthine, hypoxanthine, 2-aminoadenine, N6-alkyl derivatives, N2-alkyl, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxy, 5-halo, 5-trifluoromethyl, N7-methylguanine, N7-methyladenine, 8-azaguanine, 8-azaadenine, 7-deazaguanine, 7-deazaadenine, 3-deazaguanine, 3-deazaadenine, or any combination thereof.

Embodiment 30: The oligonucleotide of Embodiment 29, wherein the oligonucleotide comprises at least one modified nucleotide selected from the group consisting of a deoxy nucleotide, a 3'-terminal deoxythymidine (dT) nucleotide, a 2'-O-methyl modified nucleotide, a 2'-deoxy-2'-fluoro modified nucleotide, a 2'-deoxy-modified nucleotide, a 2'-5'-linked ribonucleotide (3'-RNA), a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-O-(methoxy ethyl) modified nucleotide, a 2'-O-alkyl-modified nucleotide, a morpholino nucleotide, a phosphoramidate morpholino, a non-natural base comprising nucleotide, a tetrahydropyran modified nucleotide, a 1,5-anhydrohexitol modified nucleotide, a cyclohexenyl modified nucleotide, a nucleotide comprising a 5'-phosphorothioate group, a nucleotide comprising a 5'-methylphosphonate group, a nucleotide comprising a 5'-methylphosphate group, a nucleotide comprising a 5' phosphate or 5' phosphate mimic, a nucleotide comprising vinyl phosphonate, a glycol nucleic acid (GNA), a glycol nucleic acid S-Isomer (S-GNA), a nucleotide comprising 2-hydroxymethyl-tetrahydrofurane-5-phosphate, a nucleotide comprising 2'-deoxythymidine-3'phosphate, a nucleotide comprising 2'-deoxyguanosine-3'-phosphate; a cytidine-2'-phosphate, a guanosine-2'-phosphate, a uridine-2'-phosphate, an adenosine-2'-phosphate, a 2'-O-hexadecyl-adenosine-3'-phosphate, a 2'-O-hexadecyl-cytidine-3'-phosphate, a 2'-O-hexadecyl-guanosine-3'-phosphate, and a 2'-O-hexadecyl-uridine-3'-phosphate, a 3'-3' inverted nucleotide linkage, a 5'-5' inverted nucleotide linkage, TNA, and combinations thereof.

Embodiment 31: The oligonucleotide of Embodiment 30, wherein the oligonucleotide comprises a modified nucleotide selected from the group consisting of a deoxy nucleotide, a 3'-terminal deoxythymidine (dT) nucleotide, a 3'-3' inverted nucleotide linkage, a 5'-5' inverted nucleotide linkage, a 5'-(E)-vinylphosphonate-2'-O-methyl-uridine-3'-phosphate, and a combination thereof.

Embodiment 32: The oligonucleotide of Embodiment 30 or 31, wherein the oligonucleotide comprises 5'-(E)-vinylphosphonate-2'-O-methyl-uridine-3'-phosphate.

Embodiment 33: The oligonucleotide of Embodiment 21, wherein at least one of the modifications is a thermally destabilizing nucleotide modification.

Embodiment 34: The oligonucleotide of Embodiment 33, wherein the thermally destabilizing nucleotide modification is selected from the group consisting of an abasic modification; a mismatch with the opposing nucleotide in the duplex; destabilizing sugar modification; a 2'-deoxy modification, an acyclic nucleotide, an unlocked nucleic acids (UNA); a glycerol nucleic acid (GNA), and a combination thereof.

Embodiment 35: The oligonucleotide of Embodiment 31, wherein the modification comprises a short sequence of 3'-terminal deoxythymidine nucleotide (dT).

Embodiment 36: The oligonucleotide of any one of Embodiments 21-35, wherein the modifications on the nucleotides are 2'-O-methyl and 2'deoxy-2'-fluoro modifications.

Embodiment 37: The oligonucleotide of any one of Embodiments 21-36, wherein the oligonucleotide comprises at least one phosphorothioate internucleoside or phosphorodithioate internucleoside linkage.

Embodiment 38: The oligonucleotide of Embodiment 37, wherein the oligonucleotide comprises 6-8 phosphorothioate internucleoside linkages.

Embodiment 39: The oligonucleotide of Embodiments 37 or 38, wherein the oligonucleotide comprises at least 1, or at least 2, phosphorothioate internucleoside linkage at a 5' end of the sense strand.

Embodiment 40: The oligonucleotide of any one of Embodiments 37-39, wherein the oligonucleotide comprises at least 1 phosphorothioate internucleoside linkage at a 3' end of the sense strand.

Embodiment 41: The oligonucleotide of any one of Embodiments 37-40, wherein the oligonucleotide comprises at least 1, or at least 2, phosphorothioate internucleoside linkage at a 5' end of the antisense strand.

Embodiment 42: The oligonucleotide of any one of Embodiments 37-41, wherein the oligonucleotide comprises at least 1 phosphorothioate internucleoside linkage at a 3' end of the antisense strand.

Embodiment 43: The oligonucleotide of any one of Embodiments 37-42, wherein no more than five of the nucleotides of the antisense strand are unmodified nucleotides.

Embodiment 44: The oligonucleotide of any one of Embodiments 37-43, wherein all the nucleotides of the antisense strand are modified oligonucleotides.

Embodiment 45: The oligonucleotide of any one of Embodiments 37-44, wherein no more than five of the nucleotides of the sense strand are unmodified nucleotides.

Embodiment 46: The oligonucleotide of any one of Embodiments 37-45, wherein all the nucleotides of the sense strand are modified nucleotides.

Embodiment 47: The oligonucleotide of any one of Embodiments 7-46 wherein the antisense strand comprises a chemical modification pattern according to $(Nfs)_a(nNf)_b(ns)_cn$, wherein:

n is a 2'-O-methyl-nucleoside-3'-phosphate;

Nfs is a 2'-deoxy-2'-fluoro-nucleoside-3'-phosphorothioate;

Nf is a 2'-deoxy-2'-fluoro-nucleoside-3'-phosphate;

ns is a 2'-O-methyl-nucleoside-3'-phosphorothioate, a is at least 1;

b is 5-10; and c is at least 1.

Embodiment 48: The oligonucleotide of Embodiment 47, wherein the antisense strand comprises the chemical modification pattern NfsNfsnNfnNfnNfnNfnNfnNfnNfnNfnsnsn.

Embodiment 49: The oligonucleotide of any one of Embodiments 7-48 wherein the sense strand comprises a chemical modification pattern according to $(ns)_a(Nfn)_eNf$, wherein:

n is a 2'-O-methyl-nucleoside-3'-phosphate;

Nf is a 2'-deoxy-2'-fluoro-nucleoside-3'-phosphate;

ns is a 2'-O-methyl-nucleoside-3'-phosphorothioate;

d is at least 1; and e is 5-10.

Embodiment 50: The oligonucleotide of Embodiment 49, wherein the sense strand comprises the chemical modification pattern nsnsNfnNfnNfnNfnNfnNfnNfnNfnNf.

Embodiment 51: The oligonucleotide of any one of Embodiments 7-50 wherein each of the antisense and the sense strand is independently 17-23 nucleotides in length, wherein the antisense strand comprises the motif F(SF)nSnn, wherein n is from 2 to about 20, nn is 0 or 1, one of F and S is a 2'-deoxy-2'-fluoro modified nucleoside and the other of F and S is a 2'-O-methyl modified nucleoside.

Embodiment 52: The oligonucleotide of any one of Embodiments 7-51 wherein the antisense strand comprises the chemical modification pattern of nNfnnnNfnNfNfnnnnNfnNfnnnnn and the sense strand comprises the chemical modification nnnnnnNfnNfNfNfnnnnnnnn, wherein n is a 2'-O-methyl-nucleoside and Nf is a 2'-deoxy-2'-fluoro-nucleoside.

Embodiment 53: The oligonucleotide of any one of Embodiments 7-52, wherein each of the antisense and the sense strand is independently 20-23 nucleotides in length, wherein the antisense strand comprises a region having the formula X1-Y—X2, wherein Y is a subregion of from about 5 to about 12 linked nucleosides and each of X1 subregion and X2 subregion is, independently, a plurality of linked nucleosides having the formula FSFS, where one of F and S is a 2'-deoxy-2'-fluoro modified nucleoside and the other of F and S is a 2'-O-methyl modified nucleoside; and each internucleoside linkage of said X1 subregion and X2 subregion is, independently, a phosphodiester or a phosphorothioate internucleoside linkage.

Embodiment 54: The oligonucleotide of any one of Embodiments 7-53 wherein each of the antisense and the sense strand is independently 17-23 nucleotides in length, wherein the antisense strand comprises a contiguous sequence of linked nucleosides that define an alternating motif of the formula:

5'-Q(—L—Z—L—Q)n(—L—Z)nn-3' wherein:

each L is an internucleoside linking group;

either each Q is a 2'-deoxy-2'-fluoro-nucleoside and each Z is a 2'-O-methyl nucleoside; or each Q is a 2'-O-methyl nucleoside and each Z is a 2'-deoxy-2'-fluoro nucleoside; and n is from 8 to 14 and nn is 0 or 1.

Embodiment 55: The oligonucleotide of any one of Embodiments 7-54 wherein the antisense strand is 19-25 nucleotides in length and is represented by the formula:

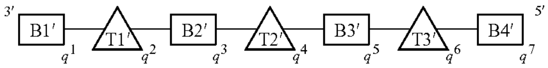

wherein:

B1', B2', B3', and B4' each independently represent a nucleotide containing a modification selected from the group consisting of 2'-O-alkyl, 2'-substituted alkoxy, 2'-substituted alkyl, 2'-halo, ENA, and BNA/LNA;

T1', T2', and T3' each independently represent a nucleotide comprising a chemical modification selected from the group consisting of DNA, RNA, LNA, 2'-deoxy-2'-fluoro, and 5'-methyl-2'-deoxy-2'-fluoro nucleotides;

q1 is 4 to 15 nucleotides in length;

q3 or q7 is independently 1-6 nucleotide(s) in length;

q2 or q6 is independently 1-3 nucleotide(s) in length;

q4 is 0-3 nucleotide(s) in length; and q5 is 0-10 nucleotide(s) in length; and wherein:

the antisense strand has 2'-deoxy-2'-fluoro modifications, and wherein the 2'-deoxy-2'-fluoro modifications on the antisense strand consist of four, and only four, 2'-deoxy-2'-fluoro modifications or six, and only six, 2'-deoxy-2'-fluoro modifications.

Embodiment 56: The oligonucleotide of any one of Embodiments 7-55 wherein the antisense strand and sense strand are each 14 to 40 nucleotides, and is represented by the formula:

(I

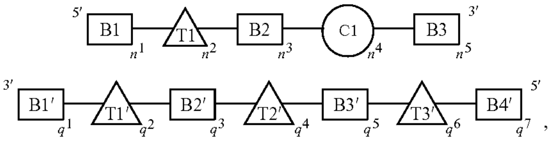

, wherein:

B1, B1', B2', B3', and B4' each independently represent a nucleotide containing a modification selected from the group consisting of 2'-O-alkyl, 2'-substituted alkoxy, 2'-substituted alkyl, 2'-halo, ENA, and BNA/LNA;

C1 is a thermally destabilizing nucleotide, selected from the group consisting of i) a nucleotide that forms a mismatch pair with the opposing nucleotide in the antisense strand, ii) a nucleotide having an abasic modification, and iii) a nucleotide having a sugar modification, and placed at a site opposite to the seed region (positions 2-8) of the antisense strand;

T1', T2', and T3' each independently represent a nucleotide comprising a modification providing the nucleotide a steric bulk that is less than or equal to the steric bulk of a 2'-OMe modification, wherein the modification is at the 2'-position of a ribose sugar of the nucleotide or at a position of a non-ribose nucleotide similar to the 2'-position of a ribose sugar;

each n1, and q1 is independently 4 to 15 nucleotides in length;

each q3, and q7 is independently 1-6 nucleotide(s) in length;

each q2 and q6 is independently 1-3 nucleotide(s) in length;

q5 is 0-10 nucleotide(s) in length;

each n4, and q4 is independently 0-3 nucleotide(s) in length;

n2 is 3 nucleotides in length, and T1 each are 2'-deoxy-2'-fluoro nucleotides;

n3 is 7 nucleotides in length, and B2 each are 2'-OMe nucleotides; and n5 is 3 nucleotides in length, and B3 each are 2'-OMe nucleotides.

Embodiment 57: The oligonucleotide of any one of Embodiments 7-56 wherein the antisense strand and sense strand are each 19-25 nucleotides in length, wherein the sense strand is represented by the formula:

(Is)

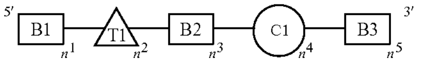

wherein:

B1, B2, and B3 each independently represent a nucleotide containing a modification selected from the group consisting of 2'-O-alkyl, 2'-substituted alkoxy, 2'-substituted alkyl, 2'-halo, ENA, and BNA/LNA;

C1 is a thermally destabilizing nucleotide, selected from the group consisting of i) a nucleotide that forms a mismatch pair with the opposing nucleotide in the antisense strand, ii) a nucleotide having an abasic modification, and iii) a nucleotide having a sugar modification, and placed at a site opposite to the seed region (positions 2-8) of the antisense strand;

T1 represents a nucleotide comprising a 2'-deoxy-2'-fluoro modification;

n1 or n3 is independently 4 to 15 nucleotides in length;

n5 is 1-6 nucleotide(s) in length;

n2 is 3;

n4 is 0-3 nucleotide(s) in length; and wherein the sense strand has 2'-deoxy-2'-fluoro modifications, and wherein the 2'-deoxy-2'-fluoro modifications on the sense strand consist of four, and only four, 2'-deoxy-2'-fluoro modifications, wherein the four 2'-deoxy-2'-fluoro modifications are at positions 7 and 9-11 from the 5'-end of the sense strand.

Embodiment 58: The oligonucleotide of any one of Embodiments 7-57, wherein the antisense strand is complementary to at least one portion of a mRNA of the target gene (e.g., DUX4), wherein:

the sense strand comprises 19-22 nucleotides, the antisense strand comprises 19-25 nucleotides; and the oligonucleotide is represented by the formula:

(I)

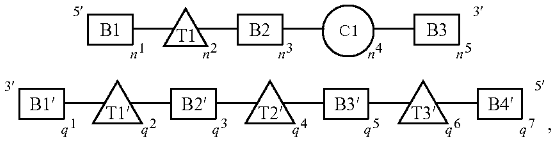

, wherein:

B1', B2', B3', and B4' each independently represent a nucleotide containing a modification selected from the group consisting of 2'-O-methyl and 2'-deoxy-2'-fluoro;

each B1, B2, and B3 is 2'-O-methyl nucleotide;

C1 is glycerol nucleic acid (GNA) placed at a site opposite to the seed region (positions 2-8) of the antisense strand;

T1', T2', and T3' are each 2'-F, wherein:

T1' is at position 14 from the 5' end of the antisense strand, and q2 is 1; and

T3' is at position 2 from the 5' end of the antisense strand, and q6 and q7 are 1;

each n1, n3, and q1 is independently 4 to 15 nucleotides in length;

each n5 and q3 is independently 1-6 nucleotide(s) in length;

q5 is 0-10 nucleotide(s) in length;

each n4 and q4 is independently 0-3 nucleotide(s) in length;

n2 is 3 nucleotides in length, and T1 each are 2'-deoxy-2'-fluoro nucleotides, and wherein (a) the oligonucleotide is covalently conjugated to at least one ligand; and (b) one of the T1 nucleotides is at position 11 from the 5' end of the sense strand.

Embodiment 59: The oligonucleotide of any one of Embodiments 7-58, wherein the sense strand comprises 19-22 nucleotides, the antisense strand comprises 19-25 nucleotides; and the oligonucleotide is represented by the formula:

(I)

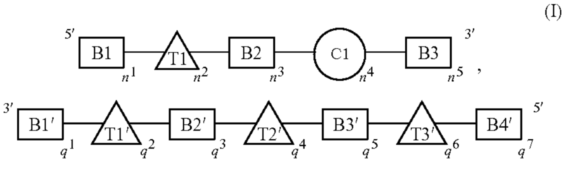

wherein:

B1', B2', B3', and B4' each independently represent a nucleotide containing a modification selected from the group consisting of 2'-O-methyl and 2'-deoxy-2'-fluoro;

each B1, B2, and B3 is 2'-OMe;

C1 is glycerol nucleic acid (GNA) placed at a site opposite to the seed region (positions 2-8) of the antisense strand;

T1', T2', and T3' are each 2'-deoxy-2'-fluoro, wherein:

T1' is at position 14 from the 5' end of the antisense strand, and q2 is 1; and

T3' is at position 2 from the 5' end of the antisense strand, and q6 and q7 are 1;

each n1, n3, and q1 is independently 4 to 15 nucleotides in length;

each n5 and q3 is independently 1-6 nucleotide(s) in length;

q5 is 0-10 nucleotide(s) in length;

each n4 and q4 is independently 0-3 nucleotide(s) in length;

n2 is 3 nucleotides in length, and T1 each are 2'-deoxy-2'-fluoro, and wherein (a) the oligonucleotide is covalently conjugated to at least one ligand; and (b) one of the T1 nucleotides is at a position in the sense strand that is opposite to position 11 from the 5' end of the antisense strand; and (c) the oligonucleotide comprises at least one phosphorothioate internucleoside linkage.

Embodiment 60: The oligonucleotide of any one of Embodiments 7-59, wherein the antisense strand and sense strand are each 14 to 40 nucleotides, wherein the antisense strand has sufficient complementarity to a target sequence to mediate RNA interference, wherein said sense strand comprises at least one thermally destabilizing modification of the duplex within the first 9 nucleotide positions of the 5' region of the antisense strand or a precursor thereof, wherein the antisense strand further comprises one or both of the following characteristics:

(i) 2, 3, 4, 5 or 6 2'-deoxy-2'-fluoro modifications; and (ii) 1, 2, 3, 4 or 5 phosphorothioate internucleoside linkages; and said sense strand comprises one or both of the following characteristics:

(iii) 2, 3, 4, or 5 2'-deoxy-2'-fluoro modifications; and (iv) 1, 2, 3, 4 or 5 phosphorothioate internucleoside linkages.

Embodiment 61: The oligonucleotide of any one of Embodiments 7-46, wherein the antisense strand comprises a modification pattern nsNfsnnnNfnNfNfnnnnNfnNfnnnsnsn, wherein ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

Embodiment 62: The oligonucleotide of any one of Embodiments 7-46, wherein the antisense strand disclosed herein comprises a modification pattern vpUs-NfsnnnNfnNfNfnnnnNfnNfnnnsnsn, wherein vpUs is a 5'-vinylphosphonate-2'-O-methyl-uridine-3'-phosphorothioate; ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

Embodiment 63: The oligonucleotide of any one of Embodiments 7-46, wherein the sense strand disclosed herein comprises a modification pattern nsnsnnNfnNfNfNfnnnnnnnnnn, wherein ns is a 2'-O-methyl-nucleoside-3'-phosphorothioate; n is a 2'-O-methyl-nucleoside-3'-phosphate; and Nf is a 2'-deoxy-2'-fluoro-nucleoside-3'-phosphate.

Embodiment 64: The oligonucleotide of any one of Embodiments 7-46, wherein the sense strand disclosed herein comprises a modification pattern NfsnsNfnNfnNfnNfnNfnNfnNfnNfnNf, wherein ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

Embodiment 65: The oligonucleotide of any one of Embodiments 7-46, wherein the sense strand comprises a modification pattern nsnsnnNfnNfNfNfnnnnnnnnnn, and the antisense strand comprises a modification pattern nsNfsnnnNfnNfNfnnnnNfnNfnnnsnsn, wherein ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

Embodiment 66: The oligonucleotide of any one of Embodiments 7-46, wherein the sense strand comprises a modification pattern nsnsnnNfnNfNfNfnnnnnnnnnn, and the antisense strand comprises a modification pattern vpUs-NfsnnnNfnNfNfnnnnNfnNfnnnsnsn, wherein vpUs is a 5'-vinylphosphonate-2'-O-methyl-uridine-3'-phosphorothioate; ns is a 2'-O-methyl-nucleoside-3'-phosphorothioate; Nfs is a 2'-deoxy-2'-fluoro-nucleoside-3'-phosphorothioate; n is a 2'-O-methyl-nucleoside-3'-phosphate; and Nf is a 2'-deoxy-2'-fluoro-nucleoside-3'-phosphate.

Embodiment 67: The oligonucleotide of any one of Embodiments 7-66, wherein the antisense strand comprises a nucleotide sequence according to any one of SEQ ID NOs: 1819-2424 or 2437-2447.

Embodiment 68: The oligonucleotide of Embodiment 67, wherein the sense strand comprises a nucleotide sequence according to any one of SEQ ID NOs: 1213-1818 or 2426-2436.

Embodiment 69: The oligonucleotide of any one of Embodiments 7-68, further comprising a terminal, chiral modification occurring at the first internucleoside linkage at the 3'-end of the antisense strand, having the linkage phosphorus atom in Sp configuration, a terminal, chiral modification occurring at the first internucleoside linkage at the 5'-end of the antisense strand, having the linkage phosphorus atom in Rp configuration, and a terminal, chiral modification occurring at the first internucleoside linkage at the 5'-end of the sense strand, having the linkage phosphorus atom in either Rp configuration or Sp configuration.

Embodiment 70: The oligonucleotide of any one of Embodiments 7-69, further comprising a terminal, chiral modification occurring at the first and second internucleoside linkages at the 3'-end of the antisense strand, having the linkage phosphorus atom in Sp configuration, a terminal, chiral modification occurring at the first internucleoside linkage at the 5'-end of the antisense strand, having the linkage phosphorus atom in Rp configuration, and a terminal, chiral modification occurring at the first internucleoside linkage at the 5'-end of the sense strand, having the linkage phosphorus atom in either Rp or Sp configuration.

Embodiment 71: The oligonucleotide of any one of Embodiments 7-70, further comprising a terminal, chiral modification occurring at the first, second and third internucleoside linkages at the 3' end of the antisense strand, having the linkage phosphorus atom in Sp configuration, a terminal, chiral modification occurring at the first internucleoside linkage at the 5'-end of the antisense strand, having the linkage phosphorus atom in Rp configuration, and a terminal, chiral modification occurring at the first internucleoside linkage at the 5'-end of the sense strand, having the linkage phosphorus atom in either Rp or Sp configuration.

Embodiment 72: The oligonucleotide of any one of Embodiments 7-71, further comprising a terminal, chiral modification occurring at the first, and second internucleoside linkages at the 3' end of the antisense strand, having the linkage phosphorus atom in Sp configuration, a terminal, chiral modification occurring at the third internucleoside linkages at the 3'-end of the antisense strand, having the linkage phosphorus atom in Rp configuration, a terminal, chiral modification occurring at the first internucleoside linkage at the 5'-end of the antisense strand, having the linkage phosphorus atom in Rp configuration, and a terminal, chiral modification occurring at the first internucleoside linkage at the 5'-end of the sense strand, having the linkage phosphorus atom in either Rp or Sp configuration.

Embodiment 73: The oligonucleotide of any one of Embodiments 7-72, further comprising a terminal, chiral modification occurring at the first, and second internucleoside linkages at the 3'-end of the antisense strand, having the linkage phosphorus atom in Sp configuration, a terminal, chiral modification occurring at the first, and second internucleoside linkages at the 5'-end of the antisense strand, having the linkage phosphorus atom in Rp configuration, and a terminal, chiral modification occurring at the first internucleoside linkage at the 5'-end of the sense strand, having the linkage phosphorus atom in either Rp or Sp configuration.

Embodiment 74: The oligonucleotide of any one of Embodiments 1-73, further comprising a phosphate or phosphate mimic at the 5'-end of the antisense strand.

Embodiment 75: The oligonucleotide of Embodiment 74, wherein the phosphate mimic is a 5'-vinyl phosphonate (VP).

Embodiment 76: The oligonucleotide of any one of Embodiments 1-75, further comprising a targeting ligand.

Embodiment 77: The oligonucleotide of Embodiment 76, wherein the targeting ligand is a small molecule-based, sugar-based (e.g., saccharide-based), fatty acid-based, protein-based, or nucleic acid-based targeting ligand.

Embodiment 78: The oligonucleotide of Embodiment 77, wherein the protein-based targeting ligand is an antibody, nanobody, affibody, peptibody, or a peptide.

Embodiment 79: An oligonucleotide selected from the sense strands, antisense strands, and RNAi agents as listed in Tables 1A, 1B, or 1F, or a pharmaceutically acceptable salt thereof.

Embodiment 80: A pharmaceutical composition comprising the oligonucleotide of any one of Embodiments 1-79, or a pharmaceutically acceptable salt thereof, and a pharmaceutically acceptable carrier or excipient.

Embodiment 81: A method for inhibiting DUX4 expression or treating a DUX4 related disorder in a subject, the method comprising administering an effective amount of the oligonucleotide of any one of Embodiments 1-79, or a pharmaceutically acceptable salt thereof, or the pharmaceutical composition of Embodiment 80 to the subject.

Embodiment 82: The method of Embodiment 81, wherein the subject is a human.

Embodiment 83: The method of Embodiment 81 or 82, wherein the reduction of DUX4 mRNA or protein expression levels is measured in a population of myocytes or cardiomyocytes derived from the subject.

Embodiment 84: The method of any one of Embodiments 81-83, wherein the reduction of DUX4 mRNA or protein expression levels is measured in tissues derived from the subject.

Embodiment 85: The method of any one of Embodiments 81-84, wherein the DUX4-related disorder is facioscapulohumeral muscular dystrophy, a DUX4-related cancer, or a DUX4-medicated viral disease.

Embodiment 86: The method of any one of Embodiments 81-85, further comprising administering to the subject an additional agent or a therapy suitable for treatment or prevention of a DUX4 related disorder.

Embodiment 87: An RNAi oligonucleotide comprising a sense strand and an antisense strand, wherein the sense strand and the antisense strand form a duplex, wherein the sense strand and antisense strands are selected from the group consisting of:

| SEQ ID NO: | Sense strand | SEQ ID NO: | Antisense strand |
|---|---|---|---|
| 1240 | csgsacGfgAfGfAfcucguuugga | 1846 | usCfscaaAfcGfAfgucuCfcGfucgsusu |
| 1438 | asgsucCfaGfGfAfuucagaucua | 2044 | usAfsgauCfuGfAfauccUfgGfacususu |
| 1443 | asusucAfgAfUfCfugguuucaga | 2049 | usCfsugaAfaCfCfagauCfuGfaausus u |
| 1626 | asasccUfcUfCfCfuagaaacgga | 2232 | usCfscguUfuCfUfaggaGfaGfguususu |
| 1645 | ascsgcUfgUfCfUfaggcaaacca | 2251 | usGfsguuUfgCfCfuagaCfaGfcgususu |
| 1654 | asgsgcAfaAfCfCfuggauuagaa | 2260 | usUfscuaAfuCfCfagguUfuGfccususu |
| 1655 | gsgscaAfaCfCfUfggauuagaga | 2261 | usCfsucuAfaUfCfcaggUfuUfgccsusu |
| 1661 | cscsugGfaUfUfAfgaguuacaua | 2267 | usAfsuguAfaCfUfcuaaUfcCfaggsusu |
| 1662 | csusggAfuUfAfGfaguuacauca | 2268 | usGfsaugUfaAfCfucuaAfuCfcagsusu |
| 1670 | asuscuCfcUfGfGfaugauuagua | 2276 | usAfscuaAfuCfAfuccaGfgAfgausus u |
| 1671 | uscsucCfuGfGfAfugauuaguua | 2277 | usAfsacuAfaUfCfauccAfgGfagasusu |
| 1672 | csusccUfgGfAfUfgauuaguuca | 2278 | usGfsaacUfaAfUfcaucCfaGfgagsusu |
| 1673 | uscscuGfgAfUfGfauuaguucaa | 2279 | usUfsgaaCfuAfAfucauCfcAfggasusu |
| 1674 | cscsugGfaUfGfAfuuaguucaga | 2280 | usCfsugaAfcUfAfaucaUfcCfaggsusu |
| 1675 | csusggAfuGfAfUfuaguucagaa | 2281 | usUfscugAfaCfUfaaucAfuCfcagsusu |
| 1775 | gscscgCfcUfCfGfcuggaagcaa | 2381 | usUfsgcuUfcCfAfgcgaGfgCfggcsusu |
| 1790 | gsasgcUfuUfAfGfgacgcgggga | 2396 | usCfscccGfcGfUfccuaAfaGfcucsusu |
| 1444 | csusggUfuUfCfAfgaaucgaaga | 2050 | usCfsuucGfaUfUfcugaAfaCfcagsusu |
| 2426 | csusGfguuUfCfAfgaAfucgaAfsgsa | 2437 | vpUsCfsuucgauucugaAfaccagsusu |
| 2427 | asgsGfcaaAfCfCfugGfauuaGfsasa | 2438 | vpUsUfscuaauccagguUfugccususu |
| 2428 | gsgsCfaaaCfCfUfggAfuuagAfsgsa | 2439 | vpUsCfsucuaauccaggUfuugccsusu |
| 2429 | cscsUfggaUfUfAfgaGfuuacAfsusa | 2440 | vpUsAfsuguaacucuaaUfccaggsusu |
| 2430 | csusGfgauUfAfGfagUfuacaUfscsa | 2441 | vpUsGfsauguaacucuaAfuccagsusu |
| 2431 | uscsUfccuGfGfAfugAfuuagUfsusa | 2442 | vpUsAfsacuaaucauccAfggagasusu |
| 2432 | csusCfcugGfAfUfgaUfuaguUfscsa | 2443 | vpUsGfsaacuaaucaucCfaggagsusu |
| 1728 | cscsgcGfcCfGfGfcagaggggaa | 2334 | usUfsccccfuCfUfgccgGfcGfcggsusu |
| 2433 | cscsGfcgcCfGfGfcaGfagggGfsasa | 2444 | vpUsUfsccccucugccgGfcgcggsusu |
| 2434 | uscsCfuggAfUfGfauUfaguuCfaa | 2445 | vpUsUfsgaacuaaucauCfcaggasusu |
| 2435 | cscsUfggaUfGfAfuuAfguucAfga | 2446 | vpUsCfsugaacuaaucaUfccaggsusu |
| 2436 | csusGfgauGfAfUfuaGfuucaGfaa | 2447 | vpUsUfscugaacuaaucAfuccagsusu |

Af represents 2'-deoxy-2'-fluoro-adenosine-3'-phosphate;

Afs represents 2'-deoxy-2'-fluoro-adenosine-3'-phosphorothioate;

Cf represents 2'-deoxy-2'-fluoro-cytidine-3'-phosphate;

Cfs represents 2'-deoxy-2'-fluoro-cytidine-3'-phosphorothioate;

Gf represents 2'-deoxy-2'-fluoro-guanosine-3'-phosphate;

Gfs represents 2'-deoxy-2'-fluoro-guanosine-3'-phosphorothioate;

Uf represents 2'-deoxy-2'-fluoro-uridine-3'-phosphate;

Ufs represents 2'-deoxy-2'-fluoro-uridine-3'-phosphorothioate;

a represents 2'-O-methyl-adenosine-3'-phosphate;

as represents 2'-O-methyl-adenosine-3'-phosphorothioate;

c represents 2'-O-methyl-cytidine-3'-phosphate;

cs represents 2'-O-methyl-cytidine-3'-phosphorothioate;

g represents 2'-O-methyl-guanosine-3'-phosphate;

gs represents 2'-O-methyl-guanosine-3'-phosphorothioate;

u represents 2'-O-methyl-uri dine-3'-phosphate;

us represents 2'-O-methyl-uridine-3'-phosphorothioate; and vpUs represents 5'-vinylphosphonate-2'-O-methyl-uridine-3'-phosphorothioate.

Embodiment 88: The RNAi oligonucleotide of Embodiment 87, wherein (i) the sense strand is csgsacGfgAfGfAfcucguuugga (SEQ ID NO: 1240), and the antisense strand is usCfscaaAfcGfAfgucuCfcGfucgsusu (SEQ ID NO: 1846); or (ii) the sense strand is asasccUfcUfCfCfuagaaacgga (SEQ ID NO: 1626), and the antisense strand is usCfscguUfuCfUfaggaGfaGfguusus (SEQ ID NO: 2232); or (iii) the sense strand is gscsgCfcUfCfGfcuggaagcaa (SEQ ID NO: 1775), and the antisense strand is usUfsgcuUfcCfAfgcgaGfgCfggcsusu (SEQ ID NO: 2381).

Embodiment 89: The RNAi oligonucleotide of Embodiment 87, wherein the sense strand is asgsucCfaGfGfAfuucagaucua (SEQ ID NO: 1438), and the antisense strand is usAfsgauCfuGfAfauccUfgGfacusus (SEQ ID NO: 2044).

Embodiment 90: The RNAi oligonucleotide of Embodiment 87, wherein the sense strand is asusucAfgAfUfCfugguucaga (SEQ ID NO: 1443), and the antisense strand is usCfsugaAfaCfCfagauCfuGfaausus (SEQ ID NO: 2049).

Embodiment 91: The RNAi oligonucleotide of Embodiment 87, wherein the sense strand is ascsgcUfgUfCfUfaggcaaacca (SEQ ID NO: 1645), and the antisense strand is usGfsguuUfgCfCfuagaCfaGfcgusus (SEQ ID NO: 2251).

Embodiment 92: The RNAi oligonucleotide of Embodiment 87, wherein the sense strand is asgsgcAfaAfCfCfuggauuagaa (SEQ ID NO: 1654), and the antisense strand is usUfscuaAfuCfCfagguUfuGfccusus (SEQ ID NO: 2260).

Embodiment 93: The RNAi oligonucleotide of Embodiment 87, wherein the sense strand is gsgscaAfaCfCfUfggauuagaga (SEQ ID NO: 1655), and the antisense strand is usCfsucuAfaUfCfcaggUfuUfgccsusu (SEQ ID NO: 2261).

Embodiment 94: The RNAi oligonucleotide of Embodiment 87, wherein the sense strand is cscsugGfaUfUfAfgaguuacaua (SEQ ID NO: 1661), and the antisense strand is usAfsuguAfaCfUfcuaaUfcCfaggsusu (SEQ ID NO: 2267).

Embodiment 95: The RNAi oligonucleotide of Embodiment 87, wherein the sense strand is csusggAfuUfAfGfaguuacauca (SEQ ID NO: 1662), and the antisense strand is usGfsaugUfaAfCfucuaAfuCfcagsusu (SEQ ID NO: 2268).

Embodiment 96: The RNAi oligonucleotide of Embodiment 87, wherein the sense strand is asuscuCfcUfGfGfaugauuagua (SEQ ID NO: 1670), and the antisense strand is usAfscuaAfuCfAfuccaGfgAfgausus (SEQ ID NO: 2276).

Embodiment 97: The RNAi oligonucleotide of Embodiment 87, wherein the sense strand is uscsucCfuGfGfAfugauuaguua (SEQ ID NO: 1671), and the antisense strand is usAfsacuAfaUfCfauccAfgGfagasusu (SEQ ID NO: 2277).

Embodiment 98: The RNAi oligonucleotide of Embodiment 87, wherein the sense strand is csusccUfgGfAfUfgauuaguuca (SEQ ID NO: 1672), and the antisense strand is usGfsaacUfaAfUfcaucCfaGfgagsusu (SEQ ID NO: 2278).

Embodiment 99: The RNAi oligonucleotide of Embodiment 87, wherein the sense strand is uscscuGfgAfUfGfauuaguucaa (SEQ ID NO: 1673), and the antisense strand is usUfsgaaCfuAfAfucauCfcAfggasusu (SEQ ID NO: 2279).

Embodiment 100: The RNAi oligonucleotide of Embodiment 87, wherein the sense strand is cscsugGfaUfGfAfuuaguucaga (SEQ ID NO: 1674), and the antisense strand is usCfsugaAfcUfAfaucaUfcCfaggsusu (SEQ ID NO: 2280).

Embodiment 101: The RNAi oligonucleotide of Embodiment 87, wherein the sense strand is csusggAfuGfAfUfuaguucagaa (SEQ ID NO: 1675), and the antisense strand is usUfscugAfaCfUfaaucAfuCfcagsusu (SEQ ID NO: 2281).

Embodiment 102: The RNAi oligonucleotide of Embodiment 87, wherein the sense strand is gsasgcUfuUfAfGfgacgcgggga (SEQ ID NO: 1790), and the antisense strand is usCfscccGfcGfUfccuaAfaGfcucsusu (SEQ ID NO: 2396).

Embodiment 103: The RNAi oligonucleotide of Embodiment 87, wherein the sense strand is csusggUfuUfCfAfgaaucgaaga (SEQ ID NO: 1444), and the antisense strand is usCfsuucGfaUfUfcugaAfaCfcagsusu (SEQ ID NO: 2050).

Embodiment 104: The RNAi oligonucleotide of Embodiment 87, wherein the sense strand is csusGfguuUfCfAfgaAfucgaAfsgsa (SEQ ID NO: 2426), and the antisense strand is vpUsCfsuucgauucugaAfaccagsusu (SEQ ID NO: 2437).

Embodiment 105: The RNAi oligonucleotide of Embodiment 87, wherein the sense strand is asgsGfcaaAfCfCfugGfauuaGfsasa (SEQ ID NO: 2427), and the antisense strand is vpUsUfscuaauccagguUfugccusus (SEQ ID NO: 2438).

Embodiment 106: The RNAi oligonucleotide of Embodiment 87, wherein the sense strand is gsgsCfaaaCfCfUfggAfuuagAfsgsa (SEQ ID NO: 2428), and the antisense strand is vpUsCfsucuaauccaggUfuugccsusu (SEQ ID NO: 2439).

Embodiment 107: The RNAi oligonucleotide of Embodiment 87, wherein the sense strand is cscsUfggaUfUfAfgaGfuuacAfsusa (SEQ ID NO: 2429), and the antisense strand is vpUsAfsuguaacucuaaUfccaggsusu (SEQ ID NO: 2440).

Embodiment 108: The RNAi oligonucleotide of Embodiment 87, wherein the sense strand is csusGfgauUfAfGfagUfuacaUfscsa (SEQ ID NO: 2430), and the antisense strand is vpUsGfsauguaacucuaAfuccagsusu (SEQ ID NO: 2441).

Embodiment 109: The RNAi oligonucleotide of Embodiment 87, wherein the sense strand is uscsUfccuGfGfAfugAfuuagUfsusa (SEQ ID NO: 2431), and the antisense strand is vpUsAfsacuaaucauccAfggagasusu (SEQ ID NO: 2442).

Embodiment 110: The RNAi oligonucleotide of Embodiment 87, wherein the sense strand is csusCfcugGfAfUfgaUfuaguUfscsa (SEQ ID NO: 2432), and the antisense strand is vpUsGfsaacuaaucaucCfaggagsusu (SEQ ID NO: 2443).

Embodiment 111: The RNAi oligonucleotide of Embodiment 87, wherein the sense strand is cscsgcGfcCfGfGfcagaggggaa (SEQ ID NO: 1728), and the antisense strand is usUfscccCfuCfUfgccgGfcGfcggsusu (SEQ ID NO: 2334).

Embodiment 112: The RNAi oligonucleotide of Embodiment 87, wherein the sense strand is cscsGfcgcCfGfGfcaGfagggGfsasa (SEQ ID NO: 2433), and the antisense strand is vpUsUfsccccucugccgGfcgcggsusu (SEQ ID NO: 2444).

Embodiment 113: The RNAi oligonucleotide of Embodiment 87, wherein the sense strand is uscsCfuggAfUfGfauUfaguuCfaa (SEQ ID NO: 2434), and the antisense strand is vpUsUfsgaacuaaucauCfcaggasusu (SEQ ID NO: 2445).

Embodiment 114: The RNAi oligonucleotide of Embodiment 87, wherein the sense strand is cscsUfggaUfGfAfuuAfguucAfga (SEQ ID NO: 2435), and the antisense strand is vpUsCfsugaacuaaucaUfccaggsusu (SEQ ID NO: 2446).

Embodiment 115: The RNAi oligonucleotide of Embodiment 87, wherein the sense strand is csusGfgauGfAfUfuaGfuucaGfaa (SEQ ID NO: 2436), and the antisense strand is vpUsUfscugaacuaaucAfuccagsusu (SEQ ID NO: 2447).

Embodiment 116: A method for inhibiting DUX4 expression or treating a DUX4 related disorder in a subject, the method comprising administering to the subject an effective amount of the RNAi oligonucleotide of Embodiment 87, or a pharmaceutically acceptable salt thereof.

The term "about" as used herein refers to the usual error range for the respective value readily known to the skilled person in this technical field. Reference to "about" a value or parameter herein includes (and describes) embodiments that are directed to that value or parameter per se.

As used herein, the singular forms "a," "an," and "the" include plural referents unless the context clearly dictates otherwise. For example, "a" or "an" means "at least one" or "one or more."

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art. All publications, including patent documents, scientific articles and databases, referred to in this application are incorporated by reference in their entirety for all purposes to the same extent as if each individual publication were individually incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

EXAMPLES

The following examples are provided to further illustrate some embodiments of the present disclosure, but are not intended to limit the scope of the disclosure; it will be understood by their exemplary nature that other procedures, methodologies, or techniques known to those skilled in the art may alternatively be used.

Example 1: DUX4 siRNA Design and Evaluation

A set of siRNAs were designed to target DUX4 (shown here as SEQ ID NO: 2425. A detailed list of the unmodified siRNA sense and antisense strand sequences is shown in Tables 1A and 1F below. A detailed list of modified siRNAs is shown in Table 1B below. Table 2 provides names for the nucleotide abbreviations used in the nucleic acid sequences herein. Oligonucleotides are chemically synthesized using phosphoramidite approach and after quality control using UV- and mass-spectroscopy sense and antisense strands were annealed to perform screening HEK293T cells were plated at a density of about 20,000 cells/well. siRNA and psiCHECK2-DUX4 plasmid transfection were carried out by adding siRNA duplexes, psiCHECK2-DUX4 plasmid, and Lipofectamine®2000 to each well. Opti-MEM® media was used to adjust the transfection mix to a final siRNA concentration of 10 nM, 5 nM, 2.5 nM, 1.25 nM, 0.625 nM, 0.3125 nM, 0.1563 nM, 0.0781 nM, 0.0391 nM, or 0.0195 nM. The cells were then incubated at room temperature for 15 minutes. The transfected cells were incubated at 37 °C in an atmosphere of 5% $CO_2$.

24 hours after transfection, Firefly (transfection control) and *Renilla* (fused to full-length DUX4 luciferase are measured. First, media is removed from cells. Then Firefly luciferase activity is measured by adding a volume of DUAL-GLO® Luciferase Reagent equal to the culture medium volume to each well. The mixture is incubated at room temperature for 30 minutes before luminescence (500 nm) was measured to detect the Firefly luciferase signal. *Renilla* luciferase activity is measured by adding DUAL-GLO® STOP & GLO® Reagent to each well and the plates are incubated for 10-15 minutes before luminescence is again measured to determine the *Renilla* luciferase signal. The DUAL-GLO® STOP & GLO® Reagent, quenches the firefly luciferase signal and sustains luminescence for the *Renilla* luciferase reaction. siRNA activity is determined by normalizing the *Renilla* (DUX4) signal to the Firefly (control) signal within each well. The magnitude of siRNA activity is then assessed relative to cells that were transfected with the same vector but were not treated with siRNA or were treated with a non-targeting siRNA.

Example 2: DUX4 siRNA Synthesis and Evaluation Using Reporter Plasmids

A set of siRNAs were designed to target DUX4 (shown here as SEQ ID NO: 2425. A detailed list of the unmodified siRNA sense and antisense strand sequences is shown in Tables 1A and 1F below. A detailed list of modified siRNAs is shown in Table 1B below. Evaluation results of knockdown efficiency are shown in Tables 1C and 1E below. Table 2 provides names for the nucleotide abbreviations used in the nucleic acid sequences herein. Oligonucleotides were chemically synthesized using phosphoramidite approach, and after quality control using UV- and mass-spectroscopy, sense and antisense strands were annealed to form duplexes suitable for screening.

Hepa1-6 cells (ATCC, CRL-1830) were maintained by biweekly passing in DMEM GlutaMAX (ThermoFisher, 10569) supplemented with 10% heat-inactivated FBS (Sigma, F4135) (D10). Hepa1-6 cells were purchased and cultured as per the manufacturer's handling guidelines to generate frozen stocks in heat-inactivated FBS supplemented with 10% DMSO. Each aliquot of cells was thawed using a 37 °C water bath for 5 minutes, and cells were transferred and quenched using D10 in 50 mL conical. Cells were then pelleted by centrifuging at 300×g for 5 minutes, spent media was aspirated, and cell pellet was resuspended to appropriate density and seeded for continuous culture.

One day prior to transfection, Hepa1-6 cells were dissociated using 1×TrypLE™ Express Enzyme (ThermoFisher, 12605010) and seeded into solid white 96-well TC plates (ThermoFisher, 136102) at 30,000 cells/well in 100 μL of D10. 96-well plates were stored overnight in a 37 °C, 5% $CO_2$ incubator.

On the day of transfection, dual transfection of siRNA and plasmid DNA were performed using two master mixes for siRNA and the reporter plasmid DNA. Previously, a designed construct of the DUX4 cDNA was inserted into a psiCheck-2 vector (Promega, C8021) and assessed for stability and luminescence intensity.

Before the transfection, individual siRNA at 5 uM were diluted into OptiMEM to make a high dose. 1:10 Serial dilutions were prepared in 96-well plates for the following doses 40, 4.0, and 0.4 nM. A negative control containing 1×phosphate buffered saline (PBS), OptiMEM, and RNAiMax were also prepared following the top dose calculations. Plasmid DNA transfection master mixes were prepared as per manufacturer's protocol, where a Lipofectamine 3000 mix (L3) was prepared by adding 0.2 μL/well of Lipofectamine 3000 (ThermoFisher, L3000075) to 5 μL/well of OptiMEM media (ThermoFisher, 31985062). The P3000 enhancer reagent master mix (P3) was prepared by adding 100 ng/well of plasmid DNA and P3000 enhancer reagent at 0.2 μL/well to 5 μL/well of OptiMEM media. Subsequently, L3 and P3 master mixes were combined 1:1 to make the L3P3 master mix and incubated at room temperature for 25 minutes. During the incubation for L3 and P3, a master mix of Lipofectamine RNAiMax (ThermoFisher, 13778150) at 0.05 μL/well and OptiMEM 30 μL/well was created. 30 μL of RNAiMax master mix was added to each diluted siRNA well for a total of 60 μL per preparation well and allowed to incubate at room temperature for 15 minutes.

Post-25-minute incubation of L3P3, previously plated cells were removed from the incubator. The spent media was aspirated and replaced with 40 μL of fresh warm OptiMEM. 10 μL of L3P3 master mix was then added to each well by multichannel pipetting. Immediately following L3P3 addition and post-15-minute incubation, 50 μL of siRNA+RNAiMax mixes were added to the appropriate replicate wells following the plate map. Following additions of both L3P3 and siRNA+RNAiMax master mixes, the cell plates were placed into a 37 °C, 5% $CO_2$ incubator.

24 hours after transfection, activities of Firefly (transfection control) and *Renilla* (fused to full-length DUX4) luciferase were measured. First, an appropriate amount of Dual-Glo Luciferase (Promega, E1960) kits containing Luciferase Assay Reagent II (LARII) and Stop-&-Glo (S&G) reagents were thawed and prepared as per manufacturer's instructions and a 1× passive lysis buffer (PLB) (Promega, E1941) was prepared from a 5× stock for 20 μL per well. The plates containing cells were removed from the 37 °C, 5% $CO_2$ incubator, and the spent media was aspirated, and 20 μL of 1×PLB was added to each well. Plates were then placed on a digital microplate shaker (Corning, CLS67804) at 800 rpm for 15 minutes at room temperature.

Post-shaking, the lysed cell plates were transferred to +4 °C storage while readouts were captured. Then, Firefly luciferase activity was measured by adding DUAL-GLO® Luciferase Reagent kit (Promega, E1960) containing Luciferase Assay Reagent II (LARII) and STOP & GLO® (S&G) reagents to each well. A Synergy H1 multimode plate reader (Agilent, 8041000N) equipped with dual injectors was used to dispense LARII and S&G, capture and read luminescence. 100 μL of LARII reagent was dispensed per well and the luminescence was captured. Following LARII reagent dispense, 100 μL of S&G was dispensed per well and the second luminescent readout was captured. The DUAL-GLO® STOP & GLO® Reagent works by quenching the firefly luciferase signal and sustaining luminescence for the *Renilla* luciferase reaction. siRNA efficacy was determined by normalizing the *Renilla*-DUX4 signal to the Firefly (control) signal within each well. The magnitude of siRNA activity was then assessed relative to cells that were transfected with the same vector but were not treated with siRNA or were treated with a non-targeting siRNA (see Tables 1C and 1E).

Example 3: DUX4 siRNA Evaluation Using Patient-Derived Cell Line

A detailed list of the unmodified siRNA sense and antisense strand sequences is shown in Tables 1A and 1F below. A detailed list of modified siRNAs is shown in Table 1B below. Evaluation results of exemplary modified siRNAs include IC50 values shown in Table 1D. Table 2 provides names for the nucleotide abbreviations used in the nucleic acid sequences disclosed herein.

FSHD MB200 cells (immortalized human myoblast cell line developed by Campbell et al., Skelet Muscle. 2017; 7(1):16) were thawed following previously established cell thawing and seeding protocol. Complete FSHD media consisting of Ham's F-10 (Gibco, 1150-043) base media and the following additives at the final concentrations: 15% FBS (CytivaHyClone, SH3007.03), 1 μM dexamethasone (Sigma, D4902), 10 ng/mL rhFGF (Peprotech, 100-18b) was used for maintenance of the MB200 cells. Cells were maintained at a density of 12,000 cells/$cm^2$ with media changes every 2 days at 37 °C, 5% $CO_2$ until cell seeding for transfection.

Cell Seeding (Day 1): On the day of cell seeding, cells were harvested from culture vessels using a 1×PBS wash followed by a 5-minute incubation with 0.25% trypsin-EDTA solution ThermoFisher, 25200056). Trypsinized cell solution was then quenched using 15 mL of fresh FSHD media, cells were then pelleted by centrifugation 300×g for 5 mins and resuspended in 10 mL of fresh FSHD media. The cell viability was assessed using a Countess 3 Cell Counter, cell solutions ≥92% viability were then set to a density of 90,000 cells per mL in warm complete FSHD media. Following 90,000 cells per mL dilution, a double confirmatory cell suspension count was carried out and a range of ±10% of target density was acceptable. 1 mL of cell solution was then plated per well of a 12-well TC plate (Falcon, 353043). Cells were then placed in a 37 °C 5% $CO_2$ incubator overnight.

Transfection for Single Dose (Day 2): 24 hours later, cells were transfected using the following protocol. siRNAs (5 μM stock) were thawed to room temperature. A 4× working stock of siRNA was prepared in 250 μL of OptiMEM (ThermoFisher, 11058021) for complexing with lipid master mix by creating a 4 nM stock from previously mentioned 5 μM stocks. A master mix of Lipofectamine RNAiMax (ThermoFisher, 13778150) at 3.0 μL/well and OptiMEM at 250 μL/well was created. 250 μL of RNAiMax master mix was then added to 250 μL of 4× siRNA in OptiMEM, and complexed for 15 minutes to generate a 500 μL/well 2× target concentration of siRNA. Cells were removed from the 37 °C 5% $CO_2$ incubator, spent FHSD media was removed and 500 μL of fresh, warm, complete FSHD media was then added to each well. Post-siRNA complexing, 500 μL of siRNA-OptiMEM-RNAiMax mix was added to each well containing cells for a dosed concentration of 1 nM. For the transfection control wells, 1×PBS was used in place of siRNA. Cells were then maintained at 37 °C 5% $CO_2$.

Transfection for IC50 Determination (Day 2): Individual siRNA at 5 μM were diluted into OptiMEM to make a top 4× dose at 40 nM for serial dilution 1:3 Serial dilutions of RNA in OptiMEM were prepared in 96-well deep plates to generate the final concentrations 10, 3, 1, $3.33\times10^{-1}$, $1.11\times10^{-1}$, $3.70\times10^{-2}$, $1.23\times10^{-2}$, $4.12\times10^{-3}$, $1.37\times10^{-3}$, $4.57\times10^{-4}$, $1.52\times10^{-4}$, $5.08\times10^{-5}$ nM. A negative control containing 1× phosphate buffered saline (PBS), OptiMEM, and RNAiMax was also prepared following the top dose calculations. Similarly to previous single dose screening, a master mix of Lipofectamine RNAiMax (ThermoFisher, 13778150) at 3.0 µL/well and OptiMEM at 250 µL/well was created. 250 µL of master mix was added to each well containing 250 µL of siRNA in OptiMEM and allowed to complex for 15-minutes. Cells were removed from the 37 °C 5% $CO_2$ incubator, spent FHSD media was removed and 500 µL of fresh, warm, complete, FSHD media was then added to each well. Post-siRNA complexing, 500 µL of siRNA-OptiMEM-RNAiMax mix was added to each well containing cells for a dosed concentration curve outlined above. Cells were maintained at 37 °C 5% $CO_2$.

Myotube Differentiation (Day 3): 24 hours post-transfection, differentiation media was prepared using DMEM Glutamax (ThermoFisher, 10569) supplemented with 10 µg/mL insulin (Sigma, 11882) and 10 µg/mL transferrin (Sigma, T0665). Cells were then removed from 37 °C 5% $CO_2$ incubator and inspected. Wells containing cells for differentiation were aspirated and 1 mL of complete differentiation media was added. For the other wells, media was removed and replaced with warm, fresh, complete FSHD media. Cells were then returned to 37 °C 5% $CO_2$ incubator for 72 hours to undergo differentiation.

Harvest (Day 6): After 72 hours, FSHD cells were harvested by completely removing media from wells and adding 500 µL Trizol for cell lysis, mixing by pipette action and transferring lysates to 96 deep well round bottom plates. Plates were labelled, sealed using aluminum foil plate seals, and then stored at −80 °C for downstream RNA isolation and RT-qPCR gene expression analysis.

RNA Isolation: RNA was isolated using the DirectZol-96 RNA kit (Zymo Research, Catalog #R2056) as per manufacturers protocol. RNA was eluted in 30 ul of RNAase/DNAse free Water and concentration was determined using a Nanodrop.

RT-qPCR: cDNA was prepared using Maxima First Strand Synthesis kit (ThermoFisher, K1641) and Taqman qPCR assays were performed using the TaqMan™ Universal PCR Master Mix (ThermoFisher, 4326708) according to the manufacturers protocol. qPCR reactions were performed for a panel of four DUX4's targets: KHDC1L (FAM, ThermoFisher, Hs1024323_g1), LEUTX (FAM, ThermoFisher, Hs01028718_m1), MBD3L2 (FAM, IDT, Hs.PT.58.24718123) and ZSCAN4 (FAM, ThermoFisher, Hs00537549_m1) multiplexed with human TBP (VIC, ThermoFisher, 4326322E) as the housekeeping gene control. Primer efficiency was determined prior to use. Thermocycling and data acquisition was performed using CFX Opus 384 Real-Time PCR System.

The mRNA levels of the target genes and the efficiency of siRNA-mediated knockdown were assessed using relative quantification. Cq values for both the target and reference (housekeeping) genes were obtained via quantitative PCR (qPCR) for each sample. Combined gene panel for KHDC1L, LEUTX, MBD3L2 and ZSCAN4 was calculated by taking the average Cq of each target and housekeeping gene. The relative expression of the target gene and gene panel was then calculated using the $2^{(-\Delta\Delta Cq)}$ method, where ΔCq represents the difference between the Cq values of the target and reference genes and ΔΔCq refers to the difference between the ΔCq values for treatment samples and only lipofectamine treated control samples.

IC50 Determination: IC50 for siRNA (as shown in Table 1D) was determined by plotting the average of the percentage of target gene expression (KHDC1L, LEUTX, MBD3L2 and ZSCAN4) against the logarithm of siRNA concentrations. A sigmoidal dose-response (variable slope) curve was fitted to the data using the Curve Fitting function in GraphPad Prism (version 7.0). The IC50 value was defined as the siRNA concentration resulting in 50% gene knockdown (see Table 1D).

TABLE 1A provides exemplary siRNAs with the sequences of the sense strand and the antisense strand.

| Position in transcript | SEQ ID NO: | Sense strand | SEQ ID NO: | Antisense strand |
|---|---|---|---|---|
| 1 | 1 | ATGGCCCTCCCGACACCCT | 607 | AGGGTGTCGGGAGGGCCAT |
| 2 | 2 | TGGCCCTCCCGACACCCTC | 608 | GAGGGTGTCGGGAGGGCCA |
| 11 | 3 | CGACACCCTCGGACAGCAC | 609 | GTGCTGTCCGAGGGTGTCG |
| 12 | 4 | GACACCCTCGGACAGCACC | 610 | GGTGCTGTCCGAGGGTGTC |
| 13 | 5 | ACACCCTCGGACAGCACCC | 611 | GGGTGCTGTCCGAGGGTGT |
| 14 | 6 | CACCCTCGGACAGCACCCT | 612 | AGGGTGCTGTCCGAGGGTG |
| 15 | 7 | ACCCTCGGACAGCACCCTC | 613 | GAGGGTGCTGTCCGAGGGT |
| 16 | 8 | CCCTCGGACAGCACCCTCC | 614 | GGAGGGTGCTGTCCGAGGG |
| 17 | 9 | CCTCGGACAGCACCCTCCC | 615 | GGGAGGGTGCTGTCCGAGG |
| 18 | 10 | CTCGGACAGCACCCTCCCC | 616 | GGGGAGGGTGCTGTCCGAG |
| 19 | 11 | TCGGACAGCACCCTCCCCG | 617 | CGGGGAGGGTGCTGTCCGA |
| 23 | 12 | ACAGCACCCTCCCCGCGGA | 618 | TCCGCGGGGAGGGTGCTGT |
| 24 | 13 | CAGCACCCTCCCCGCGGAA | 619 | TTCCGCGGGGAGGGTGCTG |
| 25 | 14 | AGCACCCTCCCCGCGGAAG | 620 | CTTCCGCGGGGAGGGTGCT |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 39 | 15 | GGAAGCCCGGGGACGAGGA | 621 | TCCTCGTCCCCGGGCTTCC |
| 40 | 16 | GAAGCCCGGGGACGAGGAC | 622 | GTCCTCGTCCCCGGGCTTC |
| 41 | 17 | AAGCCCGGGGACGAGGACG | 623 | CGTCCTCGTCCCCGGGCTT |
| 49 | 18 | GGACGAGGACGGCGACGGA | 624 | TCCGTCGCCGTCCTCGTCC |
| 50 | 19 | GACGAGGACGGCGACGGAG | 625 | CTCCGTCGCCGTCCTCGTC |
| 51 | 20 | ACGAGGACGGCGACGGAGA | 626 | TCTCCGTCGCCGTCCTCGT |
| 52 | 21 | CGAGGACGGCGACGGAGAC | 627 | GTCTCCGTCGCCGTCCTCG |
| 53 | 22 | GAGGACGGCGACGGAGACT | 628 | AGTCTCCGTCGCCGTCCTC |
| 54 | 23 | AGGACGGCGACGGAGACTC | 629 | GAGTCTCCGTCGCCGTCCT |
| 55 | 24 | GGACGGCGACGGAGACTCG | 630 | CGAGTCTCCGTCGCCGTCC |
| 56 | 25 | GACGGCGACGGAGACTCGT | 631 | ACGAGTCTCCGTCGCCGTC |
| 57 | 26 | ACGGCGACGGAGACTCGTT | 632 | AACGAGTCTCCGTCGCCGT |
| 60 | 27 | GCGACGGAGACTCGTTTGG | 633 | CCAAACGAGTCTCCGTCGC |
| 61 | 28 | CGACGGAGACTCGTTTGGA | 634 | TCCAAACGAGTCTCCGTCG |
| 62 | 29 | GACGGAGACTCGTTTGGAC | 635 | GTCCAAACGAGTCTCCGTC |
| 63 | 30 | ACGGAGACTCGTTTGGACC | 636 | GGTCCAAACGAGTCTCCGT |
| 64 | 31 | CGGAGACTCGTTTGGACCC | 637 | GGGTCCAAACGAGTCTCCG |
| 65 | 32 | GGAGACTCGTTTGGACCCC | 638 | GGGGTCCAAACGAGTCTCC |
| 66 | 33 | GAGACTCGTTTGGACCCCG | 639 | CGGGGTCCAAACGAGTCTC |
| 67 | 34 | AGACTCGTTTGGACCCCGA | 640 | TCGGGGTCCAAACGAGTCT |
| 71 | 35 | TCGTTTGGACCCCGAGCCA | 641 | TGGCTCGGGGTCCAAACGA |
| 76 | 36 | TGGACCCCGAGCCAAAGCG | 642 | CGCTTTGGCTCGGGGTCCA |
| 77 | 37 | GGACCCCGAGCCAAAGCGA | 643 | TCGCTTTGGCTCGGGGTCC |
| 78 | 38 | GACCCCGAGCCAAAGCGAG | 644 | CTCGCTTTGGCTCGGGGTC |
| 79 | 39 | ACCCCGAGCCAAAGCGAGG | 645 | CCTCGCTTTGGCTCGGGGT |
| 80 | 40 | CCCCGAGCCAAAGCGAGGC | 646 | GCCTCGCTTTGGCTCGGGG |
| 81 | 41 | CCCGAGCCAAAGCGAGGCC | 647 | GGCCTCGCTTTGGCTCGGG |
| 82 | 42 | CCGAGCCAAAGCGAGGCCC | 648 | GGGCCTCGCTTTGGCTCGG |
| 83 | 43 | CGAGCCAAAGCGAGGCCCT | 649 | AGGGCCTCGCTTTGGCTCG |
| 84 | 44 | GAGCCAAAGCGAGGCCCTG | 650 | CAGGGCCTCGCTTTGGCTC |
| 85 | 45 | AGCCAAAGCGAGGCCCTGC | 651 | GCAGGGCCTCGCTTTGGCT |
| 86 | 46 | GCCAAAGCGAGGCCCTGCG | 652 | CGCAGGGCCTCGCTTTGGC |
| 87 | 47 | CCAAAGCGAGGCCCTGCGA | 653 | TCGCAGGGCCTCGCTTTGG |
| 88 | 48 | CAAAGCGAGGCCCTGCGAG | 654 | CTCGCAGGGCCTCGCTTTG |
| 89 | 49 | AAAGCGAGGCCCTGCGAGC | 655 | GCTCGCAGGGCCTCGCTTT |
| 90 | 50 | AAGCGAGGCCCTGCGAGCC | 656 | GGCTCGCAGGGCCTCGCTT |
| 108 | 51 | CTGCTTTGAGCGGAACCCG | 657 | CGGGTTCCGCTCAAAGCAG |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 109 | 52 | TGCTTTGAGCGGAACCCGT | 658 | ACGGGTTCCGCTCAAAGCA |
| 110 | 53 | GCTTTGAGCGGAACCCGTA | 659 | TACGGGTTCCGCTCAAAGC |
| 111 | 54 | CTTTGAGCGGAACCCGTAC | 660 | GTACGGGTTCCGCTCAAAG |
| 112 | 55 | TTTGAGCGGAACCCGTACC | 661 | GGTACGGGTTCCGCTCAAA |
| 113 | 56 | TTGAGCGGAACCCGTACCC | 662 | GGGTACGGGTTCCGCTCAA |
| 114 | 57 | TGAGCGGAACCCGTACCCG | 663 | CGGGTACGGGTTCCGCTCA |
| 115 | 58 | GAGCGGAACCCGTACCCGG | 664 | CCGGGTACGGGTTCCGCTC |
| 116 | 59 | AGCGGAACCCGTACCCGGG | 665 | CCCGGGTACGGGTTCCGCT |
| 124 | 60 | CCGTACCCGGGCATCGCCA | 666 | TGGCGATGCCCGGGTACGG |
| 125 | 61 | CGTACCCGGGCATCGCCAC | 667 | GTGGCGATGCCCGGGTACG |
| 126 | 62 | GTACCCGGGCATCGCCACC | 668 | GGTGGCGATGCCCGGGTAC |
| 127 | 63 | TACCCGGGCATCGCCACCA | 669 | TGGTGGCGATGCCCGGGTA |
| 129 | 64 | CCCGGGCATCGCCACCAGA | 670 | TCTGGTGGCGATGCCCGGG |
| 130 | 65 | CCGGGCATCGCCACCAGAG | 671 | CTCTGGTGGCGATGCCCGG |
| 131 | 66 | CGGGCATCGCCACCAGAGA | 672 | TCTCTGGTGGCGATGCCCG |
| 132 | 67 | GGGCATCGCCACCAGAGAA | 673 | TTCTCTGGTGGCGATGCCC |
| 133 | 68 | GGCATCGCCACCAGAGAAC | 674 | GTTCTCTGGTGGCGATGCC |
| 134 | 69 | GCATCGCCACCAGAGAACG | 675 | CGTTCTCTGGTGGCGATGC |
| 135 | 70 | CATCGCCACCAGAGAACGG | 676 | CCGTTCTCTGGTGGCGATG |
| 136 | 71 | ATCGCCACCAGAGAACGGC | 677 | GCCGTTCTCTGGTGGCGAT |
| 137 | 72 | TCGCCACCAGAGAACGGCT | 678 | AGCCGTTCTCTGGTGGCGA |
| 138 | 73 | CGCCACCAGAGAACGGCTG | 679 | CAGCCGTTCTCTGGTGGCG |
| 144 | 74 | CAGAGAACGGCTGGCCCAG | 680 | CTGGGCCAGCCGTTCTCTG |
| 145 | 75 | AGAGAACGGCTGGCCCAGG | 681 | CCTGGGCCAGCCGTTCTCT |
| 146 | 76 | GAGAACGGCTGGCCCAGGC | 682 | GCCTGGGCCAGCCGTTCTC |
| 147 | 77 | AGAACGGCTGGCCCAGGCC | 683 | GGCCTGGGCCAGCCGTTCT |
| 148 | 78 | GAACGGCTGGCCCAGGCCA | 684 | TGGCCTGGGCCAGCCGTTC |
| 157 | 79 | GCCCAGGCCATCGGCATTC | 685 | GAATGCCGATGGCCTGGGC |
| 158 | 80 | CCCAGGCCATCGGCATTCC | 686 | GGAATGCCGATGGCCTGGG |
| 159 | 81 | CCAGGCCATCGGCATTCCG | 687 | CGGAATGCCGATGGCCTGG |
| 160 | 82 | CAGGCCATCGGCATTCCGG | 688 | CCGGAATGCCGATGGCCTG |
| 161 | 83 | AGGCCATCGGCATTCCGGA | 689 | TCCGGAATGCCGATGGCCT |
| 162 | 84 | GGCCATCGGCATTCCGGAG | 690 | CTCCGGAATGCCGATGGCC |
| 163 | 85 | GCCATCGGCATTCCGGAGC | 691 | GCTCCGGAATGCCGATGGC |
| 164 | 86 | CCATCGGCATTCCGGAGCC | 692 | GGCTCCGGAATGCCGATGG |
| 165 | 87 | CATCGGCATTCCGGAGCCC | 693 | GGGCTCCGGAATGCCGATG |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 166 | 88 | ATCGGCATTCCGGAGCCCA | 694 | TGGGCTCCGGAATGCCGAT |
| 167 | 89 | TCGGCATTCCGGAGCCCAG | 695 | CTGGGCTCCGGAATGCCGA |
| 168 | 90 | CGGCATTCCGGAGCCCAGG | 696 | CCTGGGCTCCGGAATGCCG |
| 169 | 91 | GGCATTCCGGAGCCCAGGG | 697 | CCCTGGGCTCCGGAATGCC |
| 170 | 92 | GCATTCCGGAGCCCAGGGT | 698 | ACCCTGGGCTCCGGAATGC |
| 171 | 93 | CATTCCGGAGCCCAGGGTC | 699 | GACCCTGGGCTCCGGAATG |
| 172 | 94 | ATTCCGGAGCCCAGGGTCC | 700 | GGACCCTGGGCTCCGGAAT |
| 173 | 95 | TTCCGGAGCCCAGGGTCCA | 701 | TGGACCCTGGGCTCCGGAA |
| 174 | 96 | TCCGGAGCCCAGGGTCCAG | 702 | CTGGACCCTGGGCTCCGGA |
| 175 | 97 | CCGGAGCCCAGGGTCCAGA | 703 | TCTGGACCCTGGGCTCCGG |
| 176 | 98 | CGGAGCCCAGGGTCCAGAT | 704 | ATCTGGACCCTGGGCTCCG |
| 177 | 99 | GGAGCCCAGGGTCCAGATT | 705 | AATCTGGACCCTGGGCTCC |
| 186 | 100 | GGTCCAGATTTGGTTTCAG | 706 | CTGAAACCAAATCTGGACC |
| 187 | 101 | GTCCAGATTTGGTTTCAGA | 707 | TCTGAAACCAAATCTGGAC |
| 188 | 102 | TCCAGATTTGGTTTCAGAA | 708 | TTCTGAAACCAAATCTGGA |
| 189 | 103 | CCAGATTTGGTTTCAGAAT | 709 | ATTCTGAAACCAAATCTGG |
| 190 | 104 | CAGATTTGGTTTCAGAATG | 710 | CATTCTGAAACCAAATCTG |
| 192 | 105 | GATTTGGTTTCAGAATGAG | 711 | CTCATTCTGAAACCAAATC |
| 194 | 106 | TTTGGTTTCAGAATGAGAG | 712 | CTCTCATTCTGAAACCAAA |
| 195 | 107 | TTGGTTTCAGAATGAGAGG | 713 | CCTCTCATTCTGAAACCAA |
| 196 | 108 | TGGTTTCAGAATGAGAGGT | 714 | ACCTCTCATTCTGAAACCA |
| 197 | 109 | GGTTTCAGAATGAGAGGTC | 715 | GACCTCTCATTCTGAAACC |
| 198 | 110 | GTTTCAGAATGAGAGGTCA | 716 | TGACCTCTCATTCTGAAAC |
| 199 | 111 | TTTCAGAATGAGAGGTCAC | 717 | GTGACCTCTCATTCTGAAA |
| 200 | 112 | TTCAGAATGAGAGGTCACG | 718 | CGTGACCTCTCATTCTGAA |
| 201 | 113 | TCAGAATGAGAGGTCACGC | 719 | GCGTGACCTCTCATTCTGA |
| 202 | 114 | CAGAATGAGAGGTCACGCC | 720 | GGCGTGACCTCTCATTCTG |
| 203 | 115 | AGAATGAGAGGTCACGCCA | 721 | TGGCGTGACCTCTCATTCT |
| 204 | 116 | GAATGAGAGGTCACGCCAG | 722 | CTGGCGTGACCTCTCATTC |
| 205 | 117 | AATGAGAGGTCACGCCAGC | 723 | GCTGGCGTGACCTCTCATT |
| 206 | 118 | ATGAGAGGTCACGCCAGCT | 724 | AGCTGGCGTGACCTCTCAT |
| 207 | 119 | TGAGAGGTCACGCCAGCTG | 725 | CAGCTGGCGTGACCTCTCA |
| 208 | 120 | GAGAGGTCACGCCAGCTGA | 726 | TCAGCTGGCGTGACCTCTC |
| 209 | 121 | AGAGGTCACGCCAGCTGAG | 727 | CTCAGCTGGCGTGACCTCT |
| 210 | 122 | GAGGTCACGCCAGCTGAGG | 728 | CCTCAGCTGGCGTGACCTC |
| 211 | 123 | AGGTCACGCCAGCTGAGGC | 729 | GCCTCAGCTGGCGTGACCT |
| 212 | 124 | GGTCACGCCAGCTGAGGCA | 730 | TGCCTCAGCTGGCGTGACC |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 213 | 125 | GTCACGCCAGCTGAGGCAG | 731 | CTGCCTCAGCTGGCGTGAC |
| 214 | 126 | TCACGCCAGCTGAGGCAGC | 732 | GCTGCCTCAGCTGGCGTGA |
| 215 | 127 | CACGCCAGCTGAGGCAGCA | 733 | TGCTGCCTCAGCTGGCGTG |
| 224 | 128 | TGAGGCAGCACCGGGGGGA | 734 | TCCCGCCGGTGCTGCCTCA |
| 225 | 129 | GAGGCAGCACCGGGGGGAA | 735 | TTCCCGCCGGTGCTGCCTC |
| 226 | 130 | AGGCAGCACCGGCGGGAAT | 736 | ATTCCCGCCGGTGCTGCCT |
| 227 | 131 | GGCAGCACCGGCGGGAATC | 737 | GATTCCCGCCGGTGCTGCC |
| 228 | 132 | GCAGCACCGGCGGGAATCT | 738 | AGATTCCCGCCGGTGCTGC |
| 229 | 133 | CAGCACCGGCGGGAATCTC | 739 | GAGATTCCCGCCGGTGCTG |
| 230 | 134 | AGCACCGGCGGGAATCTCG | 740 | CGAGATTCCCGCCGGTGCT |
| 231 | 135 | GCACCGGCGGGAATCTCGG | 741 | CCGAGATTCCCGCCGGTGC |
| 232 | 136 | CACCGGCGGGAATCTCGGC | 742 | GCCGAGATTCCCGCCGGTG |
| 235 | 137 | CGGCGGGAATCTCGGCCCT | 743 | AGGGCCGAGATTCCCGCCG |
| 236 | 138 | GGCGGGAATCTCGGCCCTG | 744 | CAGGGCCGAGATTCCCGCC |
| 237 | 139 | GCGGGAATCTCGGCCCTGG | 745 | CCAGGGCCGAGATTCCCGC |
| 238 | 140 | CGGGAATCTCGGCCCTGGC | 746 | GCCAGGGCCGAGATTCCCG |
| 239 | 141 | GGGAATCTCGGCCCTGGCC | 747 | GGCCAGGGCCGAGATTCCC |
| 240 | 142 | GGAATCTCGGCCCTGGCCC | 748 | GGGCCAGGGCCGAGATTCC |
| 241 | 143 | GAATCTCGGCCCTGGCCCG | 749 | CGGGCCAGGGCCGAGATTC |
| 261 | 144 | GAGACGCGGCCCGCCAGAA | 750 | TTCTGGCGGGCCGCGTCTC |
| 262 | 145 | AGACGCGGCCCGCCAGAAG | 751 | CTTCTGGCGGGCCGCGTCT |
| 273 | 146 | GCCAGAAGGCCGGCGAAAG | 752 | CTTTCGCCGGCCTTCTGGC |
| 274 | 147 | CCAGAAGGCCGGCGAAAGC | 753 | GCTTTCGCCGGCCTTCTGG |
| 275 | 148 | CAGAAGGCCGGCGAAAGCG | 754 | CGCTTTCGCCGGCCTTCTG |
| 276 | 149 | AGAAGGCCGGCGAAAGCGG | 755 | CCGCTTTCGCCGGCCTTCT |
| 277 | 150 | GAAGGCCGGCGAAAGCGGA | 756 | TCCGCTTTCGCCGGCCTTC |
| 278 | 151 | AAGGCCGGCGAAAGCGGAC | 757 | GTCCGCTTTCGCCGGCCTT |
| 285 | 152 | GCGAAAGCGGACCGCCGTC | 758 | GACGGCGGTCCGCTTTCGC |
| 286 | 153 | CGAAAGCGGACCGCCGTCA | 759 | TGACGGCGGTCCGCTTTCG |
| 287 | 154 | GAAAGCGGACCGCCGTCAC | 760 | GTGACGGCGGTCCGCTTTC |
| 288 | 155 | AAAGCGGACCGCCGTCACC | 761 | GGTGACGGCGGTCCGCTTT |
| 289 | 156 | AAGCGGACCGCCGTCACCG | 762 | CGGTGACGGCGGTCCGCTT |
| 292 | 157 | CGGACCGCCGTCACCGGAT | 763 | ATCCGGTGACGGCGGTCCG |
| 293 | 158 | GGACCGCCGTCACCGGATC | 764 | GATCCGGTGACGGCGGTCC |
| 294 | 159 | GACCGCCGTCACCGGATCC | 765 | GGATCCGGTGACGGCGGTC |
| 295 | 160 | ACCGCCGTCACCGGATCCC | 766 | GGGATCCGGTGACGGCGGT |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 296 | 161 | CCGCCGTCACCGGATCCCA | 767 | TGGGATCCGGTGACGGCGG |
| 297 | 162 | CGCCGTCACCGGATCCCAG | 768 | CTGGGATCCGGTGACGGCG |
| 298 | 163 | GCCGTCACCGGATCCCAGA | 769 | TCTGGGATCCGGTGACGGC |
| 299 | 164 | CCGTCACCGGATCCCAGAC | 770 | GTCTGGGATCCGGTGACGG |
| 300 | 165 | CGTCACCGGATCCCAGACC | 771 | GGTCTGGGATCCGGTGACG |
| 301 | 166 | GTCACCGGATCCCAGACCG | 772 | CGGTCTGGGATCCGGTGAC |
| 302 | 167 | TCACCGGATCCCAGACCGC | 773 | GCGGTCTGGGATCCGGTGA |
| 303 | 168 | CACCGGATCCCAGACCGCC | 774 | GGCGGTCTGGGATCCGGTG |
| 304 | 169 | ACCGGATCCCAGACCGCCC | 775 | GGGCGGTCTGGGATCCGGT |
| 305 | 170 | CCGGATCCCAGACCGCCCT | 776 | AGGGCGGTCTGGGATCCGG |
| 306 | 171 | CGGATCCCAGACCGCCCTG | 777 | CAGGGCGGTCTGGGATCCG |
| 307 | 172 | GGATCCCAGACCGCCCTGC | 778 | GCAGGGCGGTCTGGGATCC |
| 308 | 173 | GATCCCAGACCGCCCTGCT | 779 | AGCAGGGCGGTCTGGGATC |
| 309 | 174 | ATCCCAGACCGCCCTGCTC | 780 | GAGCAGGGCGGTCTGGGAT |
| 310 | 175 | TCCCAGACCGCCCTGCTCC | 781 | GGAGCAGGGCGGTCTGGGA |
| 311 | 176 | CCCAGACCGCCCTGCTCCT | 782 | AGGAGCAGGGCGGTCTGGG |
| 312 | 177 | CCAGACCGCCCTGCTCCTC | 783 | GAGGAGCAGGGCGGTCTGG |
| 313 | 178 | CAGACCGCCCTGCTCCTCC | 784 | GGAGGAGCAGGGCGGTCTG |
| 314 | 179 | AGACCGCCCTGCTCCTCCG | 785 | CGGAGGAGCAGGGGGGTCT |
| 315 | 180 | GACCGCCCTGCTCCTCCGA | 786 | TCGGAGGAGCAGGGCGGTC |
| 316 | 181 | ACCGCCCTGCTCCTCCGAG | 787 | CTCGGAGGAGCAGGGCGGT |
| 325 | 182 | CTCCTCCGAGCCTTTGAGA | 788 | TCTCAAAGGCTCGGAGGAG |
| 328 | 183 | CTCCGAGCCTTTGAGAAGG | 789 | CCTTCTCAAAGGCTCGGAG |
| 336 | 184 | CTTTGAGAAGGATCGCTTT | 790 | AAAGCGATCCTTCTCAAAG |
| 337 | 185 | TTTGAGAAGGATCGCTTTC | 791 | GAAAGCGATCCTTCTCAAA |
| 338 | 186 | TTGAGAAGGATCGCTTTCC | 792 | GGAAAGCGATCCTTCTCAA |
| 339 | 187 | TGAGAAGGATCGCTTTCCA | 793 | TGGAAAGCGATCCTTCTCA |
| 340 | 188 | GAGAAGGATCGCTTTCCAG | 794 | CTGGAAAGCGATCCTTCTC |
| 341 | 189 | AGAAGGATCGCTTTCCAGG | 795 | CCTGGAAAGCGATCCTTCT |
| 342 | 190 | GAAGGATCGCTTTCCAGGC | 796 | GCCTGGAAAGCGATCCTTC |
| 343 | 191 | AAGGATCGCTTTCCAGGCA | 797 | TGCCTGGAAAGCGATCCTT |
| 344 | 192 | AGGATCGCTTTCCAGGCAT | 798 | ATGCCTGGAAAGCGATCCT |
| 345 | 193 | GGATCGCTTTCCAGGCATC | 799 | GATGCCTGGAAAGCGATCC |
| 346 | 194 | GATCGCTTTCCAGGCATCG | 800 | CGATGCCTGGAAAGCGATC |
| 347 | 195 | ATCGCTTTCCAGGCATCGC | 801 | GCGATGCCTGGAAAGCGAT |
| 348 | 196 | TCGCTTTCCAGGCATCGCC | 802 | GGCGATGCCTGGAAAGCGA |
| 349 | 197 | CGCTTTCCAGGCATCGCCG | 803 | CGGCGATGCCTGGAAAGCG |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 350 | 198 | GCTTTCCAGGCATCGCCGC | 804 | GCGGCGATGCCTGGAAAGC |
| 351 | 199 | CTTTCCAGGCATCGCCGCC | 805 | GGCGGCGATGCCTGGAAAG |
| 352 | 200 | TTTCCAGGCATCGCCGCCC | 806 | GGGCGGCGATGCCTGGAAA |
| 353 | 201 | TTCCAGGCATCGCCGCCCG | 807 | CGGGGGGCGATGCCTGGAA |
| 369 | 202 | CCGGGAGGAGCTGGCCAGA | 808 | TCTGGCCAGCTCCTCCCGG |
| 370 | 203 | CGGGAGGAGCTGGCCAGAG | 809 | CTCTGGCCAGCTCCTCCCG |
| 371 | 204 | GGGAGGAGCTGGCCAGAGA | 810 | TCTCTGGCCAGCTCCTCCC |
| 372 | 205 | GGAGGAGCTGGCCAGAGAG | 811 | CTCTCTGGCCAGCTCCTCC |
| 373 | 206 | GAGGAGCTGGCCAGAGAGA | 812 | TCTCTCTGGCCAGCTCCTC |
| 374 | 207 | AGGAGCTGGCCAGAGAGAC | 813 | GTCTCTCTGGCCAGCTCCT |
| 375 | 208 | GGAGCTGGCCAGAGAGACG | 814 | CGTCTCTCTGGCCAGCTCC |
| 376 | 209 | GAGCTGGCCAGAGAGACGG | 815 | CCGTCTCTCTGGCCAGCTC |
| 377 | 210 | AGCTGGCCAGAGAGACGGG | 816 | CCCGTCTCTCTGGCCAGCT |
| 378 | 211 | GCTGGCCAGAGAGACGGGC | 817 | GCCCGTCTCTCTGGCCAGC |
| 382 | 212 | GCCAGAGAGACGGGCCTCC | 818 | GGAGGCCCGTCTCTCTGGC |
| 383 | 213 | CCAGAGAGACGGGCCTCCC | 819 | GGGAGGCCCGTCTCTCTGG |
| 384 | 214 | CAGAGAGACGGGCCTCCCG | 820 | CGGGAGGCCCGTCTCTCTG |
| 385 | 215 | AGAGAGACGGGCCTCCCGG | 821 | CCGGGAGGCCCGTCTCTCT |
| 394 | 216 | GGCCTCCCGGAGTCCAGGA | 822 | TCCTGGACTCCGGGAGGCC |
| 395 | 217 | GCCTCCCGGAGTCCAGGAT | 823 | ATCCTGGACTCCGGGAGGC |
| 396 | 218 | CCTCCCGGAGTCCAGGATT | 824 | AATCCTGGACTCCGGGAGG |
| 397 | 219 | CTCCCGGAGTCCAGGATTC | 825 | GAATCCTGGACTCCGGGAG |
| 398 | 220 | TCCCGGAGTCCAGGATTCA | 826 | TGAATCCTGGACTCCGGGA |
| 399 | 221 | CCCGGAGTCCAGGATTCAG | 827 | CTGAATCCTGGACTCCGGG |
| 400 | 222 | CCGGAGTCCAGGATTCAGA | 828 | TCTGAATCCTGGACTCCGG |
| 401 | 223 | CGGAGTCCAGGATTCAGAT | 829 | ATCTGAATCCTGGACTCCG |
| 402 | 224 | GGAGTCCAGGATTCAGATC | 830 | GATCTGAATCCTGGACTCC |
| 403 | 225 | GAGTCCAGGATTCAGATCT | 831 | AGATCTGAATCCTGGACTC |
| 404 | 226 | AGTCCAGGATTCAGATCTG | 832 | CAGATCTGAATCCTGGACT |
| 408 | 227 | CAGGATTCAGATCTGGTTT | 833 | AAACCAGATCTGAATCCTG |
| 409 | 228 | AGGATTCAGATCTGGTTTC | 834 | GAAACCAGATCTGAATCCT |
| 410 | 229 | GGATTCAGATCTGGTTTCA | 835 | TGAAACCAGATCTGAATCC |
| 411 | 230 | GATTCAGATCTGGTTTCAG | 836 | CTGAAACCAGATCTGAATC |
| 412 | 231 | ATTCAGATCTGGTTTCAGA | 837 | TCTGAAACCAGATCTGAAT |
| 420 | 232 | CTGGTTTCAGAATCGAAGG | 838 | CCTTCGATTCTGAAACCAG |
| 421 | 233 | TGGTTTCAGAATCGAAGGG | 839 | CCCTTCGATTCTGAAACCA |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 422 | 234 | GGTTTCAGAATCGAAGGGC | 840 | GCCCTTCGATTCTGAAACC |
| 423 | 235 | GTTTCAGAATCGAAGGGCC | 841 | GGCCCTTCGATTCTGAAAC |
| 424 | 236 | TTTCAGAATCGAAGGGCCA | 842 | TGGCCCTTCGATTCTGAAA |
| 425 | 237 | TTCAGAATCGAAGGGCCAG | 843 | CTGGCCCTTCGATTCTGAA |
| 426 | 238 | TCAGAATCGAAGGGCCAGG | 844 | CCTGGCCCTTCGATTCTGA |
| 427 | 239 | CAGAATCGAAGGGCCAGGC | 845 | GCCTGGCCCTTCGATTCTG |
| 428 | 240 | AGAATCGAAGGGCCAGGCA | 846 | TGCCTGGCCCTTCGATTCT |
| 429 | 241 | GAATCGAAGGGCCAGGCAC | 847 | GTGCCTGGCCCTTCGATTO |
| 430 | 242 | AATCGAAGGGCCAGGCACC | 848 | GGTGCCTGGCCCTTCGATT |
| 431 | 243 | ATCGAAGGGCCAGGCACCC | 849 | GGGTGCCTGGCCCTTCGAT |
| 432 | 244 | TCGAAGGGCCAGGCACCCG | 850 | CGGGTGCCTGGCCCTTCGA |
| 509 | 245 | GGGGTCACCCTGCTCCCTC | 851 | GAGGGAGCAGGGTGACCCC |
| 510 | 246 | GGGTCACCCTGCTCCCTCG | 852 | CGAGGGAGCAGGGTGACCC |
| 511 | 247 | GGTCACCCTGCTCCCTCGT | 853 | ACGAGGGAGCAGGGTGACC |
| 512 | 248 | GTCACCCTGCTCCCTCGTG | 854 | CACGAGGGAGCAGGGTGAC |
| 513 | 249 | TCACCCTGCTCCCTCGTGG | 855 | CCACGAGGGAGCAGGGTGA |
| 514 | 250 | CACCCTGCTCCCTCGTGGG | 856 | CCCACGAGGGAGCAGGGTG |
| 516 | 251 | CCCTGCTCCCTCGTGGGTC | 857 | GACCCACGAGGGAGCAGGG |
| 517 | 252 | CCTGCTCCCTCGTGGGTCG | 858 | CGACCCACGAGGGAGCAGG |
| 518 | 253 | CTGCTCCCTCGTGGGTCGC | 859 | GCGACCCACGAGGGAGCAG |
| 519 | 254 | TGCTCCCTCGTGGGTCGCC | 860 | GGCGACCCACGAGGGAGCA |
| 520 | 255 | GCTCCCTCGTGGGTCGCCT | 861 | AGGCGACCCACGAGGGAGC |
| 521 | 256 | CTCCCTCGTGGGTCGCCTT | 862 | AAGGCGACCCACGAGGGAG |
| 522 | 257 | TCCCTCGTGGGTCGCCTTC | 863 | GAAGGCGACCCACGAGGGA |
| 523 | 258 | CCCTCGTGGGTCGCCTTCG | 864 | CGAAGGCGACCCACGAGGG |
| 524 | 259 | CCTCGTGGGTCGCCTTCGC | 865 | GCGAAGGCGACCCACGAGG |
| 525 | 260 | CTCGTGGGTCGCCTTCGCC | 866 | GGCGAAGGCGACCCACGAG |
| 526 | 261 | TCGTGGGTCGCCTTCGCCC | 867 | GGGCGAAGGCGACCCACGA |
| 530 | 262 | GGGTCGCCTTCGCCCACAC | 868 | GTGTGGGCGAAGGCGACCC |
| 531 | 263 | GGTCGCCTTCGCCCACACC | 869 | GGTGTGGGCGAAGGCGACC |
| 532 | 264 | GTCGCCTTCGCCCACACCG | 870 | CGGTGTGGGCGAAGGCGAC |
| 533 | 265 | TCGCCTTCGCCCACACCGG | 871 | CCGGTGTGGGCGAAGGCGA |
| 544 | 266 | CACACCGGCGCGTGGGGAA | 872 | TTCCCCACGCGCCGGTGTG |
| 545 | 267 | ACACCGGCGCGTGGGGAAC | 873 | GTTCCCCACGCGCCGGTGT |
| 552 | 268 | CGCGTGGGGAACGGGGCTT | 874 | AAGCCCCGTTCCCCACGCG |
| 553 | 269 | GCGTGGGGAACGGGGCTTC | 875 | GAAGCCCCGTTCCCCACGC |
| 566 | 270 | GGCTTCCCGCACCCCACGT | 876 | ACGTGGGGTGCGGGAAGCC |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 567 | 271 | GCTTCCCGCACCCCACGTG | 877 | CACGTGGGGTGCGGGAAGC |
| 619 | 272 | TTCGTGAGCCAGGCAGCGA | 878 | TCGCTGCCTGGCTCACGAA |
| 620 | 273 | TCGTGAGCCAGGCAGCGAG | 879 | CTCGCTGCCTGGCTCACGA |
| 621 | 274 | CGTGAGCCAGGCAGCGAGG | 880 | CCTCGCTGCCTGGCTCACG |
| 622 | 275 | GTGAGCCAGGCAGCGAGGG | 881 | CCCTCGCTGCCTGGCTCAC |
| 671 | 276 | CGCCGGCAGAGGGGATCTC | 882 | GAGATCCCCTCTGCCGGCG |
| 672 | 277 | GCCGGCAGAGGGGATCTCC | 883 | GGAGATCCCCTCTGCCGGC |
| 673 | 278 | CCGGCAGAGGGGATCTCCC | 884 | GGGAGATCCCCTCTGCCGG |
| 674 | 279 | CGGCAGAGGGGATCTCCCA | 885 | TGGGAGATCCCCTCTGCCG |
| 675 | 280 | GGCAGAGGGGATCTCCCAA | 886 | TTGGGAGATCCCCTCTGCC |
| 683 | 281 | GGATCTCCCAACCTGCCCC | 887 | GGGGCAGGTTGGGAGATCC |
| 684 | 282 | GATCTCCCAACCTGCCCCG | 888 | CGGGGCAGGTTGGGAGATC |
| 685 | 283 | ATCTCCCAACCTGCCCCGG | 889 | CCGGGGCAGGTTGGGAGAT |
| 686 | 284 | TCTCCCAACCTGCCCCGGC | 890 | GCCGGGGCAGGTTGGGAGA |
| 706 | 285 | CGCGGGGATTTCGCCTACG | 891 | CGTAGGCGAAATCCCCGCG |
| 707 | 286 | GCGGGGATTTCGCCTACGC | 892 | GCGTAGGCGAAATCCCCGC |
| 708 | 287 | CGGGGATTTCGCCTACGCC | 893 | GGCGTAGGCGAAATCCCCG |
| 709 | 288 | GGGGATTTCGCCTACGCCG | 894 | CGGCGTAGGCGAAATCCCC |
| 710 | 289 | GGGATTTCGCCTACGCCGC | 895 | GCGGCGTAGGCGAAATCCC |
| 711 | 290 | GGATTTCGCCTACGCCGCC | 896 | GGCGGCGTAGGCGAAATCC |
| 712 | 291 | GATTTCGCCTACGCCGCCC | 897 | GGGCGGCGTAGGCGAAATC |
| 713 | 292 | ATTTCGCCTACGCCGCCCC | 898 | GGGGCGGCGTAGGCGAAAT |
| 714 | 293 | TTTCGCCTACGCCGCCCCG | 899 | CGGGGCGGCGTAGGCGAAA |
| 746 | 294 | GGGCGCTCTCCCACCCTCA | 900 | TGAGGGTGGGAGAGCGCCC |
| 747 | 295 | GGCGCTCTCCCACCCTCAG | 901 | CTGAGGGTGGGAGAGCGCC |
| 748 | 296 | GCGCTCTCCCACCCTCAGG | 902 | CCTGAGGGTGGGAGAGCGC |
| 749 | 297 | CGCTCTCCCACCCTCAGGC | 903 | GCCTGAGGGTGGGAGAGCG |
| 750 | 298 | GCTCTCCCACCCTCAGGCT | 904 | AGCCTGAGGGTGGGAGAGC |
| 751 | 299 | CTCTCCCACCCTCAGGCTC | 905 | GAGCCTGAGGGTGGGAGAG |
| 752 | 300 | TCTCCCACCCTCAGGCTCC | 906 | GGAGCCTGAGGGTGGGAGA |
| 753 | 301 | CTCCCACCCTCAGGCTCCT | 907 | AGGAGCCTGAGGGTGGGAG |
| 754 | 302 | TCCCACCCTCAGGCTCCTC | 908 | GAGGAGCCTGAGGGTGGGA |
| 755 | 303 | CCCACCCTCAGGCTCCTCG | 909 | CGAGGAGCCTGAGGGTGGG |
| 756 | 304 | CCACCCTCAGGCTCCTCGG | 910 | CCGAGGAGCCTGAGGGTGG |
| 757 | 305 | CACCCTCAGGCTCCTCGGT | 911 | ACCGAGGAGCCTGAGGGTG |
| 758 | 306 | ACCCTCAGGCTCCTCGGTG | 912 | CACCGAGGAGCCTGAGGGT |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 759 | 307 | CCCTCAGGCTCCTCGGTGG | 913 | CCACCGAGGAGCCTGAGGG |
| 760 | 308 | CCTCAGGCTCCTCGGTGGC | 914 | GCCACCGAGGAGCCTGAGG |
| 761 | 309 | CTCAGGCTCCTCGGTGGCC | 915 | GGCCACCGAGGAGCCTGAG |
| 767 | 310 | CTCCTCGGTGGCCTCCGCA | 916 | TGCGGAGGCCACCGAGGAG |
| 768 | 311 | TCCTCGGTGGCCTCCGCAC | 917 | GTGCGGAGGCCACCGAGGA |
| 777 | 312 | GCCTCCGCACCCGGGCAAA | 918 | TTTGCCCGGGTGCGGAGGC |
| 778 | 313 | CCTCCGCACCCGGGCAAAA | 919 | TTTTGCCCGGGTGCGGAGG |
| 779 | 314 | CTCCGCACCCGGGCAAAAG | 920 | CTTTTGCCCGGGTGCGGAG |
| 780 | 315 | TCCGCACCCGGGCAAAAGC | 921 | GCTTTTGCCCGGGTGCGGA |
| 781 | 316 | CCGCACCCGGGCAAAAGCC | 922 | GGCTTTTGCCCGGGTGCGG |
| 782 | 317 | CGCACCCGGGCAAAAGCCG | 923 | CGGCTTTTGCCCGGGTGCG |
| 788 | 318 | CGGGCAAAAGCCGGGAGGA | 924 | TCCTCCCGGCTTTTGCCCG |
| 789 | 319 | GGGCAAAAGCCGGGAGGAC | 925 | GTCCTCCCGGCTTTTGCCC |
| 790 | 320 | GGCAAAAGCCGGGAGGACC | 926 | GGTCCTCCCGGCTTTTGCC |
| 791 | 321 | GCAAAAGCCGGGAGGACCG | 927 | CGGTCCTCCCGGCTTTTGC |
| 840 | 322 | CTGCGCGGTGGCACAGCCT | 928 | AGGCTGTGCCACCGCGCAG |
| 841 | 323 | TGCGCGGTGGCACAGCCTG | 929 | CAGGCTGTGCCACCGCGCA |
| 851 | 324 | CACAGCCTGGGCCCGCTCA | 930 | TGAGCGGGCCCAGGCTGTG |
| 852 | 325 | ACAGCCTGGGCCCGCTCAA | 931 | TTGAGCGGGCCCAGGCTGT |
| 853 | 326 | CAGCCTGGGCCCGCTCAAG | 932 | CTTGAGCGGGCCCAGGCTG |
| 854 | 327 | AGCCTGGGCCCGCTCAAGC | 933 | GCTTGAGCGGGCCCAGGCT |
| 878 | 328 | CGCAGGGCCAAGGGGTGCT | 934 | AGCACCCCTTGGCCCTGCG |
| 879 | 329 | GCAGGGCCAAGGGGTGCTT | 935 | AAGCACCCCTTGGCCCTGC |
| 901 | 330 | CCACCCACGTCCCAGGGGA | 936 | TCCCCTGGGACGTGGGTGG |
| 902 | 331 | CACCCACGTCCCAGGGGAG | 937 | CTCCCCTGGGACGTGGGTG |
| 903 | 332 | ACCCACGTCCCAGGGGAGT | 938 | ACTCCCCTGGGACGTGGGT |
| 911 | 333 | CCCAGGGGAGTCCGTGGTG | 939 | CACCACGGACTCCCCTGGG |
| 912 | 334 | CCAGGGGAGTCCGTGGTGG | 940 | CCACCACGGACTCCCCTGG |
| 913 | 335 | CAGGGGAGTCCGTGGTGGG | 941 | CCCACCACGGACTCCCCTG |
| 914 | 336 | AGGGGAGTCCGTGGTGGGG | 942 | CCCCACCACGGACTCCCCT |
| 960 | 337 | GGCGGCGTGGGAACCCCAA | 943 | TTGGGGTTCCCACGCCGCC |
| 975 | 338 | CCAAGCCGGGGCAGCTCCA | 944 | TGGAGCTGCCCCGGCTTGG |
| 976 | 339 | CAAGCCGGGGCAGCTCCAC | 945 | GTGGAGCTGCCCCGGCTTG |
| 977 | 340 | AAGCCGGGGCAGCTCCACC | 946 | GGTGGAGCTGCCCCGGCTT |
| 983 | 341 | GGGCAGCTCCACCTCCCCA | 947 | TGGGGAGGTGGAGCTGCCC |
| 984 | 342 | GGCAGCTCCACCTCCCCAG | 948 | CTGGGGAGGTGGAGCTGCC |
| 985 | 343 | GCAGCTCCACCTCCCCAGC | 949 | GCTGGGGAGGTGGAGCTGC |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 986 | 344 | CAGCTCCACCTCCCCAGCC | 950 | GGCTGGGGAGGTGGAGCTG |
| 1031 | 345 | CGCGGCAGGGGCAGATGCA | 951 | TGCATCTGCCCCTGCCGCG |
| 1033 | 346 | CGGCAGGGGCAGATGCAAG | 952 | CTTGCATCTGCCCCTGCCG |
| 1034 | 347 | GGCAGGGGCAGATGCAAGG | 953 | CCTTGCATCTGCCCCTGCC |
| 1035 | 348 | GCAGGGGCAGATGCAAGGC | 954 | GCCTTGCATCTGCCCCTGC |
| 1036 | 349 | CAGGGGCAGATGCAAGGCA | 955 | TGCCTTGCATCTGCCCCTG |
| 1037 | 350 | AGGGGCAGATGCAAGGCAT | 956 | ATGCCTTGCATCTGCCCCT |
| 1046 | 351 | TGCAAGGCATCCCGGCGCC | 957 | GGCGCCGGGATGCCTTGCA |
| 1048 | 352 | CAAGGCATCCCGGCGCCCT | 958 | AGGGCGCCGGGATGCCTTG |
| 1049 | 353 | AAGGCATCCCGGCGCCCTC | 959 | GAGGGCGCCGGGATGCCTT |
| 1064 | 354 | CCTCCCAGGCGCTCCAGGA | 960 | TCCTGGAGCGCCTGGGAGG |
| 1086 | 355 | GGCGCCCTGGTCTGCACTC | 961 | GAGTGCAGACCAGGGCGCC |
| 1087 | 356 | GCGCCCTGGTCTGCACTCC | 962 | GGAGTGCAGACCAGGGCGC |
| 1088 | 357 | CGCCCTGGTCTGCACTCCC | 963 | GGGAGTGCAGACCAGGGCG |
| 1089 | 358 | GCCCTGGTCTGCACTCCCC | 964 | GGGGAGTGCAGACCAGGGC |
| 1090 | 359 | CCCTGGTCTGCACTCCCCT | 965 | AGGGGAGTGCAGACCAGGG |
| 1091 | 360 | CCTGGTCTGCACTCCCCTG | 966 | CAGGGGAGTGCAGACCAGG |
| 1092 | 361 | CTGGTCTGCACTCCCCTGC | 967 | GCAGGGGAGTGCAGACCAG |
| 1093 | 362 | TGGTCTGCACTCCCCTGCG | 968 | CGCAGGGGAGTGCAGACCA |
| 1094 | 363 | GGTCTGCACTCCCCTGCGG | 969 | CCGCAGGGGAGTGCAGACC |
| 1095 | 364 | GTCTGCACTCCCCTGCGGC | 970 | GCCGCAGGGGAGTGCAGAC |
| 1096 | 365 | TCTGCACTCCCCTGCGGCC | 971 | GGCCGCAGGGGAGTGCAGA |
| 1097 | 366 | CTGCACTCCCCTGCGGCCT | 972 | AGGCCGCAGGGGAGTGCAG |
| 1098 | 367 | TGCACTCCCCTGCGGCCTG | 973 | CAGGCCGCAGGGGAGTGCA |
| 1100 | 368 | CACTCCCCTGCGGCCTGCT | 974 | AGCAGGCCGCAGGGGAGTG |
| 1101 | 369 | ACTCCCCTGCGGCCTGCTG | 975 | CAGCAGGCCGCAGGGGAGT |
| 1103 | 370 | TCCCCTGCGGCCTGCTGCT | 976 | AGCAGCAGGCCGCAGGGGA |
| 1106 | 371 | CCTGCGGCCTGCTGCTGGA | 977 | TCCAGCAGCAGGCCGCAGG |
| 1107 | 372 | CTGCGGCCTGCTGCTGGAT | 978 | ATCCAGCAGCAGGCCGCAG |
| 1108 | 373 | TGCGGCCTGCTGCTGGATG | 979 | CATCCAGCAGCAGGCCGCA |
| 1109 | 374 | GCGGCCTGCTGCTGGATGA | 980 | TCATCCAGCAGCAGGCCGC |
| 1110 | 375 | CGGCCTGCTGCTGGATGAG | 981 | CTCATCCAGCAGCAGGCCG |
| 1111 | 376 | GGCCTGCTGCTGGATGAGC | 982 | GCTCATCCAGCAGCAGGCC |
| 1112 | 377 | GCCTGCTGCTGGATGAGCT | 983 | AGCTCATCCAGCAGCAGGC |
| 1113 | 378 | CCTGCTGCTGGATGAGCTC | 984 | GAGCTCATCCAGCAGCAGG |
| 1114 | 379 | CTGCTGCTGGATGAGCTCC | 985 | GGAGCTCATCCAGCAGCAG |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 1115 | 380 | TGCTGCTGGATGAGCTCCT | 986 | AGGAGCTCATCCAGCAGCA |
| 1116 | 381 | GCTGCTGGATGAGCTCCTG | 987 | CAGGAGCTCATCCAGCAGC |
| 1117 | 382 | CTGCTGGATGAGCTCCTGG | 988 | CCAGGAGCTCATCCAGCAG |
| 1118 | 383 | TGCTGGATGAGCTCCTGGC | 989 | GCCAGGAGCTCATCCAGCA |
| 1119 | 384 | GCTGGATGAGCTCCTGGCG | 990 | CGCCAGGAGCTCATCCAGC |
| 1130 | 385 | TCCTGGCGAGCCCGGAGTT | 991 | AACTCCGGGCTCGCCAGGA |
| 1131 | 386 | CCTGGCGAGCCCGGAGTTT | 992 | AAACTCCGGGCTCGCCAGG |
| 1132 | 387 | CTGGCGAGCCCGGAGTTTC | 993 | GAAACTCCGGGCTCGCCAG |
| 1137 | 388 | GAGCCCGGAGTTTCTGCAG | 994 | CTGCAGAAACTCCGGGCTC |
| 1138 | 389 | AGCCCGGAGTTTCTGCAGC | 995 | GCTGCAGAAACTCCGGGCT |
| 1139 | 390 | GCCCGGAGTTTCTGCAGCA | 996 | TGCTGCAGAAACTCCGGGC |
| 1140 | 391 | CCCGGAGTTTCTGCAGCAG | 997 | CTGCTGCAGAAACTCCGGG |
| 1141 | 392 | CCGGAGTTTCTGCAGCAGG | 998 | CCTGCTGCAGAAACTCCGG |
| 1142 | 393 | CGGAGTTTCTGCAGCAGGC | 999 | GCCTGCTGCAGAAACTCCG |
| 1143 | 394 | GGAGTTTCTGCAGCAGGCG | 1000 | CGCCTGCTGCAGAAACTCC |
| 1144 | 395 | GAGTTTCTGCAGCAGGCGC | 1001 | GCGCCTGCTGCAGAAACTC |
| 1145 | 396 | AGTTTCTGCAGCAGGCGCA | 1002 | TGCGCCTGCTGCAGAAACT |
| 1146 | 397 | GTTTCTGCAGCAGGCGCAA | 1003 | TTGCGCCTGCTGCAGAAAC |
| 1147 | 398 | TTTCTGCAGCAGGCGCAAC | 1004 | GTTGCGCCTGCTGCAGAAA |
| 1148 | 399 | TTCTGCAGCAGGCGCAACC | 1005 | GGTTGCGCCTGCTGCAGAA |
| 1149 | 400 | TCTGCAGCAGGCGCAACCT | 1006 | AGGTTGCGCCTGCTGCAGA |
| 1150 | 401 | CTGCAGCAGGCGCAACCTC | 1007 | GAGGTTGCGCCTGCTGCAG |
| 1151 | 402 | TGCAGCAGGCGCAACCTCT | 1008 | AGAGGTTGCGCCTGCTGCA |
| 1152 | 403 | GCAGCAGGCGCAACCTCTC | 1009 | GAGAGGTTGCGCCTGCTGC |
| 1153 | 404 | CAGCAGGCGCAACCTCTCC | 1010 | GGAGAGGTTGCGCCTGCTG |
| 1154 | 405 | AGCAGGCGCAACCTCTCCT | 1011 | AGGAGAGGTTGCGCCTGCT |
| 1155 | 406 | GCAGGCGCAACCTCTCCTA | 1012 | TAGGAGAGGTTGCGCCTGC |
| 1156 | 407 | CAGGCGCAACCTCTCCTAG | 1013 | CTAGGAGAGGTTGCGCCTG |
| 1157 | 408 | AGGCGCAACCTCTCCTAGA | 1014 | TCTAGGAGAGGTTGCGCCT |
| 1158 | 409 | GGCGCAACCTCTCCTAGAA | 1015 | TTCTAGGAGAGGTTGCGCC |
| 1159 | 410 | GCGCAACCTCTCCTAGAAA | 1016 | TTTCTAGGAGAGGTTGCGC |
| 1160 | 411 | CGCAACCTCTCCTAGAAAC | 1017 | GTTTCTAGGAGAGGTTGCG |
| 1161 | 412 | GCAACCTCTCCTAGAAACG | 1018 | CGTTTCTAGGAGAGGTTGC |
| 1162 | 413 | CAACCTCTCCTAGAAACGG | 1019 | CCGTTTCTAGGAGAGGTTG |
| 1163 | 414 | AACCTCTCCTAGAAACGGA | 1020 | TCCGTTTCTAGGAGAGGTT |
| 1169 | 415 | TCCTAGAAACGGAGGCCCC | 1021 | GGGGCCTCCGTTTCTAGGA |
| 1170 | 416 | CCTAGAAACGGAGGCCCCG | 1022 | CGGGGCCTCCGTTTCTAGG |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 1171 | 417 | CTAGAAACGGAGGCCCCGG | 1023 | CCGGGGCCTCCGTTTCTAG |
| 1428 | 418 | CCGGTGAGAGACTCCACTC | 1024 | GAGTGGAGTCTCTCACCGG |
| 1429 | 419 | CGGTGAGAGACTCCACTCC | 1025 | GGAGTGGAGTCTCTCACCG |
| 1430 | 420 | GGTGAGAGACTCCACTCCG | 1026 | CGGAGTGGAGTCTCTCACC |
| 1570 | 421 | CCCTTGTTCTTCCGTGAAA | 1027 | TTTCACGGAAGAACAAGGG |
| 1571 | 422 | CCTTGTTCTTCCGTGAAAT | 1028 | ATTTCACGGAAGAACAAGG |
| 1572 | 423 | CTTGTTCTTCCGTGAAATT | 1029 | AATTTCACGGAAGAACAAG |
| 1573 | 424 | TTGTTCTTCCGTGAAATTC | 1030 | GAATTTCACGGAAGAACAA |
| 1574 | 425 | TGTTCTTCCGTGAAATTCT | 1031 | AGAATTTCACGGAAGAACA |
| 1575 | 426 | GTTCTTCCGTGAAATTCTG | 1032 | CAGAATTTCACGGAAGAAC |
| 1576 | 427 | TTCTTCCGTGAAATTCTGG | 1033 | CCAGAATTTCACGGAAGAA |
| 1577 | 428 | TCTTCCGTGAAATTCTGGC | 1034 | GCCAGAATTTCACGGAAGA |
| 1578 | 429 | CTTCCGTGAAATTCTGGCT | 1035 | AGCCAGAATTTCACGGAAG |
| 1589 | 430 | TTCTGGCTGAATGTCTCCC | 1036 | GGGAGACATTCAGCCAGAA |
| 1590 | 431 | TCTGGCTGAATGTCTCCCC | 1037 | GGGGAGACATTCAGCCAGA |
| 1618 | 432 | GACGCTGTCTAGGCAAACC | 1038 | GGTTTGCCTAGACAGCGTC |
| 1619 | 433 | ACGCTGTCTAGGCAAACCT | 1039 | AGGTTTGCCTAGACAGCGT |
| 1620 | 434 | CGCTGTCTAGGCAAACCTG | 1040 | CAGGTTTGCCTAGACAGCG |
| 1621 | 435 | GCTGTCTAGGCAAACCTGG | 1041 | CCAGGTTTGCCTAGACAGC |
| 1622 | 436 | CTGTCTAGGCAAACCTGGA | 1042 | TCCAGGTTTGCCTAGACAG |
| 1623 | 437 | TGTCTAGGCAAACCTGGAT | 1043 | ATCCAGGTTTGCCTAGACA |
| 1624 | 438 | GTCTAGGCAAACCTGGATT | 1044 | AATCCAGGTTTGCCTAGAC |
| 1625 | 439 | TCTAGGCAAACCTGGATTA | 1045 | TAATCCAGGTTTGCCTAGA |
| 1626 | 440 | CTAGGCAAACCTGGATTAG | 1046 | CTAATCCAGGTTTGCCTAG |
| 1627 | 441 | TAGGCAAACCTGGATTAGA | 1047 | TCTAATCCAGGTTTGCCTA |
| 1628 | 442 | AGGCAAACCTGGATTAGAG | 1048 | CTCTAATCCAGGTTTGCCT |
| 1629 | 443 | GGCAAACCTGGATTAGAGT | 1049 | ACTCTAATCCAGGTTTGCC |
| 1630 | 444 | GCAAACCTGGATTAGAGTT | 1050 | AACTCTAATCCAGGTTTGC |
| 1631 | 445 | CAAACCTGGATTAGAGTTA | 1051 | TAACTCTAATCCAGGTTTG |
| 1632 | 446 | AAACCTGGATTAGAGTTAC | 1052 | GTAACTCTAATCCAGGTTT |
| 1633 | 447 | AACCTGGATTAGAGTTACA | 1053 | TGTAACTCTAATCCAGGTT |
| 1634 | 448 | ACCTGGATTAGAGTTACAT | 1054 | ATGTAACTCTAATCCAGGT |
| 1635 | 449 | CCTGGATTAGAGTTACATC | 1055 | GATGTAACTCTAATCCAGG |
| 1636 | 450 | CTGGATTAGAGTTACATCT | 1056 | AGATGTAACTCTAATCCAG |
| 1637 | 451 | TGGATTAGAGTTACATCTC | 1057 | GAGATGTAACTCTAATCCA |
| 1638 | 452 | GGATTAGAGTTACATCTCC | 1058 | GGAGATGTAACTCTAATCC |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 1639 | 453 | GATTAGAGTTACATCTCCT | 1059 | AGGAGATGTAACTCTAATC |
| 1640 | 454 | ATTAGAGTTACATCTCCTG | 1060 | CAGGAGATGTAACTCTAAT |
| 1641 | 455 | TTAGAGTTACATCTCCTGG | 1061 | CCAGGAGATGTAACTCTAA |
| 1642 | 456 | TAGAGTTACATCTCCTGGA | 1062 | TCCAGGAGATGTAACTCTA |
| 1643 | 457 | AGAGTTACATCTCCTGGAT | 1063 | ATCCAGGAGATGTAACTCT |
| 1651 | 458 | ATCTCCTGGATGATTAGTT | 1064 | AACTAATCATCCAGGAGAT |
| 1652 | 459 | TCTCCTGGATGATTAGTTC | 1065 | GAACTAATCATCCAGGAGA |
| 1653 | 460 | CTCCTGGATGATTAGTTCA | 1066 | TGAACTAATCATCCAGGAG |
| 1654 | 461 | TCCTGGATGATTAGTTCAG | 1067 | CTGAACTAATCATCCAGGA |
| 1655 | 462 | CCTGGATGATTAGTTCAGA | 1068 | TCTGAACTAATCATCCAGG |
| 1656 | 463 | CTGGATGATTAGTTCAGAG | 1069 | CTCTGAACTAATCATCCAG |
| 26 | 464 | GCACCCTCCCCGCGGAAGC | 1070 | GCTTCCGCGGGGAGGGTGC |
| 27 | 465 | CACCCTCCCCGCGGAAGCC | 1071 | GGCTTCCGCGGGGAGGGTG |
| 28 | 466 | ACCCTCCCCGOGGAAGCCC | 1072 | GGGCTTCCGCGGGGAGGGT |
| 30 | 467 | CCTCCCCGCGGAAGCCCGG | 1073 | CCGGGCTTCCGCGGGGAGG |
| 35 | 468 | CCGCGGAAGCCCGGGGACG | 1074 | CGTCCCCGGGCTTCCGCGG |
| 37 | 469 | GCGGAAGCCCGGGGACGAG | 1075 | CTCGTCCCCGGGCTTCCGC |
| 38 | 470 | CGGAAGCCCGGGGACGAGG | 1076 | CCTCGTCCCCGGGCTTCCG |
| 193 | 471 | ATTTGGTTTCAGAATGAGA | 1077 | TCTCATTCTGAAACCAAAT |
| 233 | 472 | ACCGGCGGGAATCTCGGCC | 1078 | GGCCGAGATTCCCGCCGGT |
| 250 | 473 | CCCTGGCCCGGGAGACGCG | 1079 | CGCGTCTCCCGGGCCAGGG |
| 251 | 474 | CCTGGCCCGGGAGACGCGG | 1080 | CCGCGTCTCCCGGGCCAGG |
| 252 | 475 | CTGGCCCGGGAGACGCGGC | 1081 | GCCGCGTCTCCCGGGCCAG |
| 263 | 476 | GACGCGGCCCGCCAGAAGG | 1082 | CCTTCTGGGGGGCCGCGTC |
| 264 | 477 | ACGCGGCCCGCCAGAAGGC | 1083 | GCCTTCTGGCGGGCCGCGT |
| 279 | 478 | AGGCCGGCGAAAGCGGACC | 1084 | GGTCCGCTTTCGCCGGCCT |
| 280 | 479 | GGCCGGCGAAAGCGGACCG | 1085 | CGGTCCGCTTTCGCCGGCC |
| 281 | 480 | GCCGGCGAAAGCGGACCGC | 1086 | GCGGTCCGCTTTCGCCGGC |
| 317 | 481 | CCGCCCTGCTCCTCCGAGC | 1087 | GCTCGGAGGAGCAGGGCGG |
| 355 | 482 | CCAGGCATCGCCGCCCGGG | 1088 | CCCGGGGGGCGATGCCTGG |
| 359 | 483 | GCATCGCCGCCCGGGAGGA | 1089 | TCCTCCCGGGGGGCGATGC |
| 360 | 484 | CATCGCCGCCCGGGAGGAG | 1090 | CTCCTCCCGGGCGGCGATG |
| 361 | 485 | ATCGCCGCCCGGGAGGAGC | 1091 | GCTCCTCCCGGGGGGCGAT |
| 362 | 486 | TCGCCGCCCGGGAGGAGCT | 1092 | AGCTCCTCCCGGGCGGCGA |
| 363 | 487 | CGCCGCCCGGGAGGAGCTG | 1093 | CAGCTCCTCCCGGGGGGCG |
| 437 | 488 | GGGCCAGGCACCCGGGACA | 1094 | TGTCCCGGGTGCCTGGCCC |
| 452 | 489 | GACAGGGTGGCAGGGCGCC | 1095 | GGCGCCCTGCCACCCTGTC |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 453 | 490 | ACAGGGTGGCAGGGCGCCC | 1096 | GGGCGCCCTGCCACCCTGT |
| 455 | 491 | AGGGTGGCAGGGCGCCCGC | 1097 | GCGGGCGCCCTGCCACCCT |
| 456 | 492 | GGGTGGCAGGGCGCCCGCG | 1098 | CGCGGGCGCCCTGCCACCC |
| 458 | 493 | GTGGCAGGGCGCCCGCGCA | 1099 | TGCGCGGGCGCCCTGCCAC |
| 480 | 494 | AGGCGGCCTGTGCAGCGCG | 1100 | CGCGCTGCACAGGCCGCCT |
| 481 | 495 | GGCGGCCTGTGCAGCGCGG | 1101 | CCGCGCTGCACAGGCCGCC |
| 482 | 496 | GCGGCCTGTGCAGCGCGGC | 1102 | GCCGCGCTGCACAGGCCGC |
| 534 | 497 | CGCCTTCGCCCACACCGGC | 1103 | GCCGGTGTGGGCGAAGGCG |
| 546 | 498 | CACCGGCGCGTGGGGAACG | 1104 | CGTTCCCCACGCGCCGGTG |
| 547 | 499 | ACCGGCGCGTGGGGAACGG | 1105 | CCGTTCCCCACGCGCCGGT |
| 548 | 500 | CCGGCGCGTGGGGAACGGG | 1106 | CCCGTTCCCCACGCGCCGG |
| 549 | 501 | CGGCGCGTGGGGAACGGGG | 1107 | CCCCGTTCCCCACGCGCCG |
| 551 | 502 | GCGCGTGGGGAACGGGGCT | 1108 | AGCCCCGTTCCCCACGCGC |
| 565 | 503 | GGGCTTCCCGCACCCCACG | 1109 | CGTGGGGTGCGGGAAGCCC |
| 575 | 504 | CACCCCACGTGCCCTGCGC | 1110 | GCGCAGGGCACGTGGGGTG |
| 577 | 505 | CCCCACGTGCCCTGCGCGC | 1111 | GCGCGCAGGGCACGTGGGG |
| 579 | 506 | CCACGTGCCCTGCGCGCCT | 1112 | AGGCGCGCAGGGCACGTGG |
| 581 | 507 | ACGTGCCCTGCGCGCCTGG | 1113 | CCAGGCGCGCAGGGCACGT |
| 588 | 508 | CTGCGCGCCTGGGGCTCTC | 1114 | GAGAGCCCCAGGCGCGCAG |
| 616 | 509 | GCTTTCGTGAGCCAGGCAG | 1115 | CTGCCTGGCTCACGAAAGC |
| 617 | 510 | CTTTCGTGAGCCAGGCAGC | 1116 | GCTGCCTGGCTCACGAAAG |
| 618 | 511 | TTTCGTGAGCCAGGCAGCG | 1117 | CGCTGCCTGGCTCACGAAA |
| 627 | 512 | CCAGGCAGCGAGGGCCGCC | 1118 | GGCGGCCCTCGCTGCCTGG |
| 652 | 513 | CTGCAGCCCAGCCAGGCCG | 1119 | CGGCCTGGCTGGGCTGCAG |
| 654 | 514 | GCAGCCCAGCCAGGCCGCG | 1120 | CGCGGCCTGGCTGGGCTGC |
| 659 | 515 | CCAGCCAGGCCGCGCCGGC | 112 | GCCGGCGCGGCCTGGCTGG |
| 668 | 516 | CCGCGCCGGCAGAGGGGAT | 1122 | ATCCCCTCTGCCGGCGCGG |
| 690 | 517 | CCAACCTGCCCCGGCGCGC | 1123 | GCGCGCCGGGGCAGGTTGG |
| 692 | 518 | AACCTGCCCCGGCGCGCGG | 1124 | CCGCGCGCCGGGGCAGGTT |
| 705 | 519 | GCGCGGGGATTTCGCCTAC | 1125 | GTAGGCGAAATCCCCGCGC |
| 715 | 520 | TTCGCCTACGCCGCCCCGG | 1126 | CCGGGGCGGCGTAGGCGAA |
| 717 | 521 | CGCCTACGCCGCCCCGGCT | 1127 | AGCCGGGGCGGCGTAGGCG |
| 732 | 522 | GGCTCCTCCGGACGGGGCG | 1128 | CGCCCCGTCCGGAGGAGCC |
| 733 | 523 | GCTCCTCCGGACGGGGCGC | 1129 | GCGCCCCGTCCGGAGGAGC |
| 745 | 524 | GGGGCGCTCTCCCACCCTC | 1130 | GAGGGTGGGAGAGCGCCCC |
| 802 | 525 | GAGGACCGGGACCCGCAGC | 1131 | GCTGCGGGTCCCGGTCCTC |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 809 | 526 | GGGACCCGCAGCGCGACGG | 1132 | CCGTCGCGCTGCGGGTCCC |
| 813 | 527 | CCCGCAGCGCGACGGCCTG | 1133 | CAGGCCGTCGCGCTGCGGG |
| 827 | 528 | GCCTGCCGGGCCCCTGCGC | 1134 | GCGCAGGGGCCCGGCAGGC |
| 839 | 529 | CCTGCGCGGTGGCACAGCC | 1135 | GGCTGTGCCACCGCGCAGG |
| 842 | 530 | GCGCGGTGGCACAGCCTGG | 1136 | CCAGGCTGTGCCACCGCGC |
| 843 | 531 | CGCGGTGGCACAGCCTGGG | 1137 | CCCAGGCTGTGCCACCGCG |
| 845 | 532 | CGGTGGCACAGCCTGGGCC | 1138 | GGCCCAGGCTGTGCCACCG |
| 850 | 533 | GCACAGCCTGGGCCCGCTC | 1139 | GAGCGGGCCCAGGCTGTGC |
| 856 | 534 | CCTGGGCCCGCTCAAGCGG | 1140 | CCGCTTGAGCGGGCCCAGG |
| 877 | 535 | CCGCAGGGCCAAGGGGTGC | 1141 | GCACCCCTTGGCCCTGCGG |
| 892 | 536 | GTGCTTGCGCCACCCACGT | 1142 | ACGTGGGTGGCGCAAGCAC |
| 893 | 537 | TGCTTGCGCCACCCACGTC | 1143 | GACGTGGGTGGCGCAAGCA |
| 894 | 538 | GCTTGCGCCACCCACGTCC | 1144 | GGACGTGGGTGGCGCAAGC |
| 895 | 539 | CTTGCGCCACCCACGTCCC | 1145 | GGGACGTGGGTGGCGCAAG |
| 897 | 540 | TGCGCCACCCACGTCCCAG | 1146 | CTGGGACGTGGGTGGCGCA |
| 919 | 541 | AGTCCGTGGTGGGGCTGGG | 1147 | CCCAGCCCCACCACGGACT |
| 936 | 542 | GGGCCGGGGTCCCCAGGTC | 1148 | GACCTGGGGACCCCGGCCC |
| 939 | 543 | CCGGGGTCCCCAGGTCGCC | 1149 | GGCGACCTGGGGACCCCGG |
| 956 | 544 | CCGGGGCGGCGTGGGAACC | 1150 | GGTTCCCACGCCGCCCCGG |
| 989 | 545 | CTCCACCTCCCCAGCCCGC | 1151 | GCGGGCTGGGGAGGTGGAG |
| 992 | 546 | CACCTCCCCAGCCCGCGCC | 1152 | GGCGCGGGCTGGGGAGGTG |
| 994 | 547 | CCTCCCCAGCCCGCGCCCC | 1153 | GGGGCGCGGGCTGGGGAG G |
| 1023 | 548 | CGCCTCCGCGCGGCAGGGG | 1154 | CCCCTGCCGCGCGGAGGCG |
| 1028 | 549 | CCGCGCGGCAGGGGCAGAT | 1155 | ATCTGCCCCTGCCGCGCGG |
| 1030 | 550 | GCGCGGCAGGGGCAGATGC | 1156 | GCATCTGCCCCTGCCGCGC |
| 1067 | 551 | CCCAGGCGCTCCAGGAGCC | 1157 | GGCTCCTGGAGCGCCTGGG |
| 1081 | 552 | GAGCCGGCGCCCTGGTCTG | 1158 | CAGACCAGGGCGCCGGCTC |
| 1083 | 553 | GCCGGCGCCCTGGTCTGCA | 1159 | TGCAGACCAGGGCGCCGGC |
| 1084 | 554 | CCGGCGCCCTGGTCTGCAC | 1160 | GTGCAGACCAGGGCGCCGG |
| 1085 | 555 | CGGCGCCCTGGTCTGCACT | 1161 | AGTGCAGACCAGGGCGCCG |
| 1102 | 556 | CTCCCCTGCGGCCTGCTGC | 1162 | GCAGCAGGCCGCAGGGGAG |
| 1120 | 557 | CTGGATGAGCTCCTGGCGA | 1163 | TCGCCAGGAGCTCATCCAG |
| 1189 | 558 | GGGGAGCTGGAGGCCTCGG | 1164 | CCGAGGCCTCCAGCTCCCC |
| 1192 | 559 | GAGCTGGAGGCCTCGGAAG | 1165 | CTTCCGAGGCCTCCAGCTC |
| 1193 | 560 | AGCTGGAGGCCTCGGAAGA | 1166 | TCTTCCGAGGCCTCCAGCT |
| 1194 | 561 | GCTGGAGGCCTCGGAAGAG | 1167 | CTCTTCCGAGGCCTCCAGC |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 1212 | 562 | GGCCGCCTCGCTGGAAGCA | 1168 | TGCTTCCAGCGAGGCGGCC |
| 1213 | 563 | GCCGCCTCGCTGGAAGCAC | 1169 | GTGCTTCCAGCGAGGCGGC |
| 1214 | 564 | CCGCCTCGCTGGAAGCACC | 1170 | GGTGCTTCCAGCGAGGCGG |
| 1215 | 565 | CGCCTCGCTGGAAGCACCC | 1171 | GGGTGCTTCCAGCGAGGCG |
| 1216 | 566 | GCCTCGCTGGAAGCACCCC | 1172 | GGGGTGCTTCCAGCGAGGC |
| 1218 | 567 | CTCGCTGGAAGCACCCCTC | 1173 | GAGGGGTGCTTCCAGCGAG |
| 1234 | 568 | CTCAGCGAGGAAGAATACC | 1174 | GGTATTCTTCCTCGCTGAG |
| 1235 | 569 | TCAGCGAGGAAGAATACCG | 1175 | CGGTATTCTTCCTCGCTGA |
| 1242 | 570 | GGAAGAATACCGGGCTCTG | 1176 | CAGAGCCCGGTATTCTTCC |
| 1251 | 571 | CCGGGCTCTGCTGGAGGAG | 1177 | CTCCTCCAGCAGAGCCCGG |
| 1257 | 572 | TCTGCTGGAGGAGCTTTAG | 1178 | CTAAAGCTCCTCCAGCAGA |
| 1258 | 573 | CTGCTGGAGGAGCTTTAGG | 1179 | CCTAAAGCTCCTCCAGCAG |
| 1260 | 574 | GCTGGAGGAGCTTTAGGAC | 1180 | GTCCTAAAGCTCCTCCAGC |
| 1261 | 575 | CTGGAGGAGCTTTAGGACG | 1181 | CGTCCTAAAGCTCCTCCAG |
| 1265 | 576 | AGGAGCTTTAGGACGCGGG | 1182 | CCCGCGTCCTAAAGCTCCT |
| 1266 | 577 | GGAGCTTTAGGACGCGGGG | 1183 | CCCCGCGTCCTAAAGCTCC |
| 1267 | 578 | GAGCTTTAGGACGCGGGGT | 1184 | ACCCCGCGTCCTAAAGCTC |
| 1268 | 579 | AGCTTTAGGACGCGGGGTT | 1185 | AACCCCGCGTCCTAAAGCT |
| 1269 | 580 | GCTTTAGGACGCGGGGTTG | 1186 | CAACCCCGCGTCCTAAAGC |
| 1270 | 581 | CTTTAGGACGCGGGGTTGG | 1187 | CCAACCCCGCGTCCTAAAG |
| 1271 | 582 | TTTAGGACGCGGGGTTGGG | 1188 | CCCAACCCCGCGTCCTAAA |
| 1272 | 583 | TTAGGACGCGGGGTTGGGA | 1189 | TCCCAACCCCGCGTCCTAA |
| 1274 | 584 | AGGACGCGGGGTTGGGACG | 1190 | CGTCCCAACCCCGCGTCCT |
| 1279 | 585 | GCGGGGTTGGGACGGGGTC | 1191 | GACCCCGTCCCAACCCCGC |
| 1284 | 586 | GTTGGGACGGGGTCGGGTG | 1192 | CACCCGACCCCGTCCCAAC |
| 1288 | 587 | GGACGGGGTCGGGTGGTTC | 1193 | GAACCACCCGACCCCGTCC |
| 1389 | 588 | GGCTGACCGGCCTGGGATT | 1194 | AATCCCAGGCCGGTCAGCC |
| 1390 | 589 | GCTGACCGGCCTGGGATTC | 1195 | GAATCCCAGGCCGGTCAGC |
| 1400 | 590 | CTGGGATTCCTGCCTTCTA | 1196 | TAGAAGGCAGGAATCCCAG |
| 1401 | 591 | TGGGATTCCTGCCTTCTAG | 1197 | CTAGAAGGCAGGAATCCCA |
| 1419 | 592 | GGTCTAGGCCCGGTGAGAG | 1198 | CTCTCACCGGGCCTAGACC |
| 1420 | 593 | GTCTAGGCCCGGTGAGAGA | 1199 | TCTCTCACCGGGCCTAGAC |
| 1421 | 594 | TCTAGGCCCGGTGAGAGAC | 1200 | GTCTCTCACCGGGCCTAGA |
| 1422 | 595 | CTAGGCCCGGTGAGAGACT | 1201 | AGTCTCTCACCGGGCCTAG |
| 1425 | 596 | GGCCCGGTGAGAGACTCCA | 1202 | TGGAGTCTCTCACCGGGCC |
| 1426 | 597 | GCCCGGTGAGAGACTCCAC | 1203 | GTGGAGTCTCTCACCGGGC |
| 1427 | 598 | CCCGGTGAGAGACTCCACT | 1204 | AGTGGAGTCTCTCACCGGG |

TABLE 1A-continued provides exemplary siRNAs with the sequences of the sense strand and the antisense strand.

| Position in transcript | SEQ ID NO: | Sense strand | SEQ ID NO: | Antisense strand |
|---|---|---|---|---|
| 1607 | 599 | CCCCACCTTCCGACGCTGT | 1205 | ACAGCGTCGGAAGGTGGGG |
| 1608 | 600 | CCCACCTTCCGACGCTGTC | 1206 | GACAGCGTCGGAAGGTGGG |
| 1612 | 601 | CCTTCCGACGCTGTCTAGG | 1207 | CCTAGACAGCGTCGGAAGG |
| 1613 | 602 | CTTCCGACGCTGTCTAGGC | 1208 | GCCTAGACAGCGTCGGAAG |
| 1614 | 603 | TTCCGACGCTGTCTAGGCA | 1209 | TGCCTAGACAGCGTCGGAA |
| 1615 | 604 | TCCGACGCTGTCTAGGCAA | 1210 | TTGCCTAGACAGCGTCGGA |
| 1616 | 605 | CCGACGCTGTCTAGGCAAA | 1211 | TTTGCCTAGACAGCGTCGG |
| 1617 | 606 | CGACGCTGTCTAGGCAAAC | 1212 | GTTTGCCTAGACAGCGTCG |

Column 1 shows the beginning position of the target sequence in DUX4_human_#NM_001306068.3 (SEQ ID NO: 2425).
The target sequence is 19 nucleotide long starting from the beginning position.
For example, row 1 shows that the beginning position of the target sequence is 1, which means that the target sequence is the sequence corresponding to positions 1-19 of DUX4_human_#NM_001306068.3 (SEQ ID NO: 2425).
The sequences of the sense strands and antisense strands are shown from the 5' end to the 3' end.

TABLE 1B provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1 | 1213 | asusggCfcCfUfCfccgacaccca | 1819 | usGfsgguGfuCfGfggagGfgCfca ususu |
| 2 | 1214 | usgsgcCfcUfCfCfcgacacccua | 1820 | usAfsgggUfgUfCfgggaGfgGfcc asusu |
| 11 | 1215 | csgsacAfcCfCfUfcggacagcaa | 1821 | usUfsgcuGfuCfCfgaggGfuGfuc gsusu |
| 12 | 1216 | gsascaCfcCfUfCfggacagcaca | 1822 | usGfsugcUfgUfCfcgagGfgUfgu csusu |
| 13 | 1217 | ascsacCfcUfCfGfgacagcacca | 1823 | usGfsgugCfuGfUfccgaGfgGfug ususu |
| 14 | 1218 | csasccCfuCfGfGfacagcaccca | 1824 | usGfsgguGfcUfGfuccgAfgGfgu gsusu |
| 15 | 1219 | ascsccUfcGfGfAfcagcacccua | 1825 | usAfsgggUfgCfUfguccGfaGfgg ususu |
| 16 | 1220 | cscscuCfgGfAfCfagcacccuca | 1826 | usGfsaggGfuGfCfugucCfgAfgg gsusu |
| 17 | 1221 | cscsucGfgAfCfAfgcacccucca | 1827 | usGfsgagGfgUfGfcuguCfcGfag gsusu |
| 18 | 1222 | csuscgGfaCfAfGfcacccuccca | 1828 | usGfsggaGfgGfUfgcugUfcCfga gsusu |
| 19 | 1223 | uscsggAfcAfGfCfacccuccccca | 1829 | usGfsgggAfgGfGfugcuGfuCfcg asusu |
| 23 | 1224 | ascsagCfaCfCfCfuccccgcgga | 1830 | usCfscgcGfgGfGfagggUfgCfug ususu |
| 24 | 1225 | csasgcAfcCfCfUfccccgcggaa | 1831 | usUfsccgCfgGfGfgaggGfuGfcu gsusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 25 | 1226 | asgscaCfcCfUfCfcccgcggaaa | 1832 | usUfsuccGfcGfGfggagGfgUfgcususu |
| 39 | 1227 | gsgsaaGfcCfCfGfgggacgagga | 1833 | usCfscucGfuCfCfccggGfcUfuccsusu |
| 40 | 1228 | gsasagCfcCfGfGfggacgaggaa | 1834 | usUfsccuCfgUfCfcccgGfgCfuucsusu |
| 41 | 1229 | asasgcCfcGfGfGfgacgaggaca | 1835 | usGfsuccUfcGfUfccccGfgGfcuususu |
| 49 | 1230 | gsgsacGfaGfGfAfcggcgacgga | 1836 | usCfscguCfgCfCfguccUfcGfuccsusu |
| 50 | 1231 | gsascgAfgGfAfCfggcgacggaa | 1837 | usUfsccgUfcGfCfcgucCfuCfgucsusu |
| 51 | 1232 | ascsgaGfgAfCfGfgcgacggaga | 1838 | usCfsuccGfuCfGfccguCfcUfcgususu |
| 52 | 1233 | csgsagGfaCfGfGfcgacggagaa | 1839 | usUfscucCfgUfCfgccgUfcCfucgsusu |
| 53 | 1234 | gsasggAfcGfGfCfgacggagaca | 1840 | usGfsucuCfcGfUfcgccGfuCfcucsusu |
| 54 | 1235 | asgsgaCfgGfCfGfacggagacua | 1841 | usAfsgucUfcCfGfucgcCfgUfccususu |
| 55 | 1236 | gsgsacGfgCfGfAfcggagacuca | 1842 | usGfsaguCfuCfCfgucgCfcGfuccsusu |
| 56 | 1237 | gsascgGfcGfAfCfggagacucga | 1843 | usCfsgagUfcUfCfcgucGfcCfgucsusu |
| 57 | 1238 | ascsggCfgAfCfGfgagacucgua | 1844 | usAfscgaGfuCfUfccguCfgCfcgususu |
| 60 | 1239 | gscsgaCfgGfAfGfacucguuuga | 1845 | usCfsaaaCfgAfGfucucCfgUfcgcsusu |
| 61 | 1240 | csgsacGfgAfGfAfcucguuugga | 1846 | usCfscaaAfcGfAfgucuCfcGfucgsusu |
| 62 | 1241 | gsascgGfaGfAfCfucguuuggaa | 1847 | usUfsccaAfaCfGfagucUfcCfgucsusu |
| 63 | 1242 | ascsggAfgAfCfUfcguuuggaca | 1848 | usGfsuccAfaAfCfgaguCfuCfcgususu |
| 64 | 1243 | csgsgaGfaCfUfCfguuuggacca | 1849 | usGfsgucCfaAfAfcgagUfcUfccgsusu |
| 65 | 1244 | gsgsagAfcUfCfGfuuuggaccca | 1850 | usGfsgguCfcAfAfacgaGfuCfuccsusu |
| 66 | 1245 | gsasgaCfuCfGfUfuuggacccca | 1851 | usGfsgggUfcCfAfaacgAfgUfcucsusu |
| 67 | 1246 | asgsacUfcGfUfUfuggaccccga | 1852 | usCfsgggGfuCfCfaaacGfaGfucususu |
| 71 | 1247 | uscsguUfuGfGfAfccccgagcca | 1853 | usGfsgcuCfgGfGfguccAfaAfcgasusu |
| 76 | 1248 | usgsgaCfcCfCfGfagccaaagca | 1854 | usGfscuuUfgGfCfucggGfgUfccasusu |
| 77 | 1249 | gsgsacCfcCfGfAfgccaaagcga | 1855 | usCfsgcuUfuGfGfcucgGfgGfuccsusu |
| 78 | 1250 | gsasccCfcGfAfGfccaaagcgaa | 1856 | usUfscgcUfuUfGfgcucGfgGfgu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| | | | | csusu |
| 79 | 1251 | ascsccCfgAfGfCfcaaagcgaga | 1857 | usCfsucgCfuUfUfggcuCfgGfgg ususu |
| 80 | 1252 | cscsccGfaGfCfCfaaagcgagga | 1858 | usCfscucGfcUfUfuggcUfcGfgg gsusu |
| 81 | 1253 | cscscgAfgCfCfAfaagcgaggca | 1859 | usGfsccuCfgCfUfuuggCfuCfgg gsusu |
| 82 | 1254 | cscsgaGfcCfAfAfagcgaggcca | 1860 | usGfsgccUfcGfCfuuugGfcUfcg gsusu |
| 83 | 1255 | csgsagCfcAfAfAfgcgaggccca | 1861 | usGfsggcCfuCfGfcuuuGfgCfuc gsusu |
| 84 | 1256 | gsasgcCfaAfAfGfcgaggcccua | 1862 | usAfsgggCfcUfCfgcuuUfgGfcu csusu |
| 85 | 1257 | asgsccAfaAfGfCfgaggcccuga | 1863 | usCfsaggGfcCfUfcgcuUfuGfgc ususu |
| 86 | 1258 | gscscaAfaGfCfGfaggcccugca | 1864 | usGfscagGfgCfCfucgcUfuUfgg csusu |
| 87 | 1259 | cscsaaAfgCfGfAfggcccugcga | 1865 | usCfsgcaGfgGfCfcucgCfuUfug gsusu |
| 88 | 1260 | csasaaGfcGfAfGfgcccugcgaa | 1866 | usUfscgcAfgGfGfccucGfcUfuu gsusu |
| 89 | 1261 | asasagCfgAfGfGfcccugcgaga | 1867 | usCfsucgCfaGfGfgccuCfgCfuu ususu |
| 90 | 1262 | asasgcGfaGfGfCfccugcgagca | 1868 | usGfscucGfcAfGfggccUfcGfcu ususu |
| 108 | 1263 | csusgcUfuUfGfAfgcggaaccca | 1869 | usGfsgguUfcCfGfcucaAfaGfca gsusu |
| 109 | 1264 | usgscuUfuGfAfGfcggaacccga | 1870 | usCfsgggUfuCfCfgcucAfaAfgc asusu |
| 110 | 1265 | gscsuuUfgAfGfCfggaacccgua | 1871 | usAfscggGfuUfCfcgcuCfaAfag csusu |
| 111 | 1266 | csusuuGfaGfCfGfgaacccguaa | 1872 | usUfsacgGfgUfUfccgcUfcAfaa gsusu |
| 112 | 1267 | ususugAfgCfGfGfaacccguaca | 1873 | usGfsuacGfgGfUfuccgCfuCfaa asusu |
| 113 | 1268 | ususgaGfcGfGfAfacccguacca | 1874 | usGfsguaCfgGfGfuuccGfcUfca asusu |
| 114 | 1269 | usgsagCfgGfAfAfcccguaccca | 1875 | usGfsgguAfcGfGfguucCfgCfuc asusu |
| 115 | 1270 | gsasgcGfgAfAfCfccguacccga | 1876 | usCfsgggUfaCfGfgguuCfcGfcu csusu |
| 116 | 1271 | asgscgGfaAfCfCfcguacccgga | 1877 | usCfscggGfuAfCfggguUfcCfgc ususu |
| 124 | 1272 | cscsguAfcCfCfGfggcaucgcca | 1878 | usGfsgcgAfuGfCfccggGfuAfcg gsusu |
| 125 | 1273 | csgsuaCfcCfGfGfgcaucgccaa | 1879 | usUfsggcGfaUfGfcccgGfgUfac gsusu |
| 126 | 1274 | gsusacCfcGfGfGfcaucgccaca | 1880 | usGfsuggCfgAfUfgcccGfgGfua csusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 127 | 1275 | usasccCfgGfGfCfaucgccacca | 1881 | usGfsgugGfcGfAfugccCfgGfgu asusu |
| 129 | 1276 | cscscgGfgCfAfUfcgccaccaga | 1882 | usCfsuggUfgGfCfgaugCfcCfgg gsusu |
| 130 | 1277 | cscsggGfcAfUfCfgccaccagaa | 1883 | usUfscugGfuGfGfcgauGfcCfcg gsusu |
| 131 | 1278 | csgsggCfaUfCfGfccaccagaga | 1884 | usCfsucuGfgUfGfgcgaUfgCfcc gsusu |
| 132 | 1279 | gsgsgcAfuCfGfCfcaccagagaa | 1885 | usUfscucUfgGfUfggcgAfuGfcc csusu |
| 133 | 1280 | gsgscaUfcGfCfCfaccagagaaa | 1886 | usUfsucuCfuGfGfuggcGfaUfgc csusu |
| 134 | 1281 | gscsauCfgCfCfAfccagagaaca | 1887 | usGfsuucUfcUfGfguggCfgAfug csusu |
| 135 | 1282 | csasucGfcCfAfCfcagagaacga | 1888 | usCfsguuCfuCfUfggugGfcGfau gsusu |
| 136 | 1283 | asuscgCfcAfCfCfagagaacgga | 1889 | usCfscguUfcUfCfugguGfgCfga ususu |
| 137 | 1284 | uscsgcCfaCfCfAfgagaacggca | 1890 | usGfsccgUfuCfUfcuggUfgGfcg asusu |
| 138 | 1285 | csgsccAfcCfAfGfagaacggcua | 1891 | usAfsgccGfuUfCfucugGfuGfgc gsusu |
| 144 | 1286 | csasgaGfaAfCfGfgcuggcccaa | 1892 | usUfsgggCfcAfGfccguUfcUfcu gsusu |
| 145 | 1287 | asgsagAfaCfGfGfcuggcccaga | 1893 | usCfsuggGfcCfAfgccgUfuCfuc ususu |
| 146 | 1288 | gsasgaAfcGfGfCfuggcccagga | 1894 | usCfscugGfgCfCfagccGfuUfcu csusu |
| 147 | 1289 | asgsaaCfgGfCfUfggcccaggca | 1895 | usGfsccuGfgGfCfcagcCfgUfuc ususu |
| 148 | 1290 | gsasacGfgCfUfGfgcccaggcca | 1896 | usGfsgccUfgGfGfccagCfcGfuu csusu |
| 157 | 1291 | gscsccAfgGfCfCfaucggcauua | 1897 | usAfsaugCfcGfAfuggcCfuGfgg csusu |
| 158 | 1292 | cscscaGfgCfCfAfucggcauuca | 1898 | usGfsaauGfcCfGfauggCfcUfgg gsusu |
| 159 | 1293 | cscsagGfcCfAfUfcggcauucca | 1899 | usGfsgaaUfgCfCfgaugGfcCfug gsusu |
| 160 | 1294 | csasggCfcAfUfCfggcauuccga | 1900 | usCfsggaAfuGfCfcgauGfgCfcu gsusu |
| 161 | 1295 | asgsgcCfaUfCfGfgcauuccgga | 1901 | usCfscggAfaUfGfccgaUfgGfcc ususu |
| 162 | 1296 | gsgsccAfuCfGfGfcauuccggaa | 1902 | usUfsccgGfaAfUfgccgAfuGfgc csusu |
| 163 | 1297 | gscscaUfcGfGfCfauuccggaga | 1903 | usCfsuccGfgAfAfugccGfaUfgg csusu |
| 164 | 1298 | cscsauCfgGfCfAfuuccggagca | 1904 | usGfscucCfgGfAfaugcCfgAfug gsusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 165 | 1299 | csasucGfgCfAfUfuccggagcca | 1905 | usGfsgcuCfcGfGfaaugCfcGfau gsusu |
| 166 | 1300 | asuscgGfcAfUfUfccggagccca | 1906 | usGfsggcUfcCfGfgaauGfcCfga ususu |
| 167 | 1301 | uscsggCfaUfUfCfcggagcccaa | 1907 | usUfsgggCfuCfCfggaaUfgCfcg asusu |
| 168 | 1302 | csgsgcAfuUfCfCfggagcccaga | 1908 | usCfsuggGfcUfCfcggaAfuGfcc gsusu |
| 169 | 1303 | gsgscaUfuCfCfGfgagcccagga | 1909 | usCfscugGfgCfUfccggAfaUfgc csusu |
| 170 | 1304 | gscsauUfcCfGfGfagcccaggga | 1910 | usCfsccuGfgGfCfuccgGfaAfug csusu |
| 171 | 1305 | csasuuCfcGfGfAfgcccagggua | 1911 | usAfscccUfgGfGfcuccGfgAfau gsusu |
| 172 | 1306 | asusucCfgGfAfGfcccaggguca | 1912 | usGfsaccCfuGfGfgcucCfgGfaa ususu |
| 173 | 1307 | ususccGfgAfGfCfccaggggucca | 1913 | usGfsgacCfcUfGfggcuCfcGfga asusu |
| 174 | 1308 | uscscgGfaGfCfCfcaggguccaa | 1914 | usUfsggaCfcCfUfgggcUfcCfgg asusu |
| 175 | 1309 | cscsggAfgCfCfCfaggguccaga | 1915 | usCfsuggAfcCfCfugggCfuCfcg gsusu |
| 176 | 1310 | csgsgaGfcCfCfAfggguccagaa | 1916 | usUfscugGfaCfCfcuggGfcUfcc gsusu |
| 177 | 1311 | gsgsagCfcCfAfGfgguccagaua | 1917 | usAfsucuGfgAfCfccugGfgCfuc csusu |
| 186 | 1312 | gsgsucCfaGfAfUfuugguuucaa | 1918 | usUfsgaaAfcCfAfaaucUfgGfac csusu |
| 187 | 1313 | gsusccAfgAfUfUfugguuucaga | 1919 | usCfsugaAfaCfCfaaauCfuGfga csusu |
| 188 | 1314 | uscscaGfaUfUfUfgguuucagaa | 1920 | usUfscugAfaAfCfcaaaUfcUfgg asusu |
| 189 | 1315 | cscsagAfuUfUfGfguuucagaaa | 1921 | usUfsucuGfaAfAfccaaAfuCfug gsusu |
| 190 | 1316 | csasgaUfuUfGfGfuuucagaaua | 1922 | usAfsuucUfgAfAfaccaAfaUfcu gsusu |
| 192 | 1317 | gsasuuUfgGfUfUfucagaaugaa | 1923 | usUfscauUfcUfGfaaacCfaAfau csusu |
| 194 | 1318 | ususugGfuUfUfCfagaaugagaa | 1924 | usUfscucAfuUfCfugaaAfcCfaa asusu |
| 195 | 1319 | ususggUfuUfCfAfgaaugagaga | 1925 | usCfsucuCfaUfUfcugaAfaCfca asusu |
| 196 | 1320 | usgsguUfuCfAfGfaaugagagga | 1926 | usCfscucUfcAfUfucugAfaAfcc asusu |
| 197 | 1321 | gsgsuuUfcAfGfAfaugagaggua | 1927 | usAfsccuCfuCfAfuucuGfaAfac csusu |
| 198 | 1322 | gsusuuCfaGfAfAfugagagguca | 1928 | usGfsaccUfcUfCfauucUfgAfaa csusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 199 | 1323 | ususucAfgAfAfUfgagaggucaa | 1929 | usUfsgacCfuCfUfcauuCfuGfaa asusu |
| 200 | 1324 | ususcaGfaAfUfGfagaggucaca | 1930 | usGfsugaCfcUfCfucauUfcUfga asusu |
| 201 | 1325 | uscsagAfaUfGfAfgaggucacga | 1931 | usCfsgugAfcCfUfcucaUfuCfug asusu |
| 202 | 1326 | csasgaAfuGfAfGfaggucacgca | 1932 | usGfscguGfaCfCfucucAfuUfcu gsusu |
| 203 | 1327 | asgsaaUfgAfGfAfggucacgcca | 1933 | usGfsgcgUfgAfCfcucuCfaUfuc ususu |
| 204 | 1328 | gsasauGfaGfAfGfgucacgccaa | 1934 | usUfsggcGfuGfAfccucUfcAfuu csusu |
| 205 | 1329 | asasugAfgAfGfGfucacgccaga | 1935 | usCfsuggCfgUfGfaccuCfuCfau ususu |
| 206 | 1330 | asusgaGfaGfGfUfcacgccagca | 1936 | usGfscugGfcGfUfgaccUfcUfca ususu |
| 207 | 1331 | usgsagAfgGfUfCfacgccagcua | 1937 | usAfsgcuGfgCfGfugacCfuCfuc asusu |
| 208 | 1332 | gsasgaGfgUfCfAfcgccagcuga | 1938 | usCfsagcUfgGfCfgugaCfcUfcu csusu |
| 209 | 1333 | asgsagGfuCfAfCfgccagcugaa | 1939 | usUfscagCfuGfGfcgugAfcCfuc ususu |
| 210 | 1334 | gsasggUfcAfCfGfccagcugaga | 1940 | usCfsucaGfcUfGfgcguGfaCfcu csusu |
| 211 | 1335 | asgsguCfaCfGfCfcagcugagga | 1941 | usCfscucAfgCfUfggcgUfgAfcc ususu |
| 212 | 1336 | gsgsucAfcGfCfCfagcugaggca | 1942 | usGfsccuCfaGfCfuggcGfuGfac csusu |
| 213 | 1337 | gsuscaCfgCfCfAfgcugaggcaa | 1943 | usUfsgccUfcAfGfcuggCfgUfga csusu |
| 214 | 1338 | uscsacGfcCfAfGfcugaggcaga | 1944 | usCfsugcCfuCfAfgcugGfcGfug asusu |
| 215 | 1339 | csascgCfcAfGfCfugaggcagca | 1945 | usGfscugCfcUfCfagcuGfgCfgu gsusu |
| 224 | 1340 | usgsagGfcAfGfCfaccggcggga | 1946 | usCfsccgCfcGfGfugcuGfcCfuc asusu |
| 225 | 1341 | gsasggCfaGfCfAfccggcgggaa | 1947 | usUfscccGfcCfGfgugcUfgCfcu csusu |
| 226 | 1342 | asgsgcAfgCfAfCfcggcgggaaa | 1948 | usUfsuccCfgCfCfggugCfuGfcc ususu |
| 227 | 1343 | gsgscaGfcAfCfCfggcgggaaua | 1949 | usAfsuucCfcGfCfcgguGfcUfgc csusu |
| 228 | 1344 | gscsagCfaCfCfGfgcgggaauca | 1950 | usGfsauuCfcCfGfccggUfgCfug csusu |
| 229 | 1345 | csasgcAfcCfGfGfcgggaaucua | 1951 | usAfsgauUfcCfCfgccgGfuGfcu gsusu |
| 230 | 1346 | asgscaCfcGfGfCfgggaaucuca | 1952 | usGfsagaUfuCfCfcgccGfgUfgc ususu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 231 | 1347 | gscsacCfgGfCfGfggaaucucga | 1953 | usCfsgagAfuUfCfccgcCfgGfug csusu |
| 232 | 1348 | csasccGfgCfGfGfgaaucucgga | 1954 | usCfscgaGfaUfUfcccgCfcGfgu gsusu |
| 235 | 1349 | csgsgcGfgGfAfAfucucggccca | 1955 | usGfsggcCfgAfGfauucCfcGfcc gsusu |
| 236 | 1350 | gsgscgGfgAfAfUfcucggcccua | 1956 | usAfsgggCfcGfAfgauuCfcCfgc csusu |
| 237 | 1351 | gscsggGfaAfUfCfucggcccuga | 1957 | usCfsaggGfcCfGfagauUfcCfcg csusu |
| 238 | 1352 | csgsggAfaUfCfUfcggcccugga | 1958 | usCfscagGfgCfCfgagaUfuCfcc gsusu |
| 239 | 1353 | gsgsgaAfuCfUfCfggcccuggca | 1959 | usGfsccaGfgGfCfcgagAfuUfcc csusu |
| 240 | 1354 | gsgsaaUfcUfCfGfgcccuggcca | 1960 | usGfsgccAfgGfGfccgaGfaUfuc csusu |
| 241 | 1355 | gsasauCfuCfGfGfcccuggccca | 1961 | usGfsggcCfaGfGfgccgAfgAfuu csusu |
| 261 | 1356 | gsasgaCfgCfGfGfcccgccagaa | 1962 | usUfscugGfcGfGfgccgCfgUfcu csusu |
| 262 | 1357 | asgsacGfcGfGfCfccgccagaaa | 1963 | usUfsucuGfgCfGfggccGfcGfuc ususu |
| 273 | 1358 | gscscaGfaAfGfGfccggcgaaaa | 1964 | usUfsuucGfcCfGfgccuUfcUfgg csusu |
| 274 | 1359 | cscsagAfaGfGfCfcggcgaaaga | 1965 | usCfsuuuCfgCfCfggccUfuCfug gsusu |
| 275 | 1360 | csasgaAfgGfCfCfggcgaaagca | 1966 | usGfscuuUfcGfCfcggcCfuUfcu gsusu |
| 276 | 1361 | asgsaaGfgCfCfGfgcgaaagcga | 1967 | usCfsgcuUfuCfGfccggCfcUfuc ususu |
| 277 | 1362 | gsasagGfcCfGfGfcgaaagcgga | 1968 | usCfscgcUfuUfCfgccgGfcCfuu csusu |
| 278 | 1363 | asasggCfcGfGfCfgaaagcggaa | 1969 | usUfsccgCfuUfUfcgccGfgCfcu ususu |
| 285 | 1364 | gscsgaAfaGfCfGfgaccgccgua | 1970 | usAfscggCfgGfUfccgcUfuUfcg csusu |
| 286 | 1365 | csgsaaAfgCfGfGfaccgccguca | 1971 | usGfsacgGfcGfGfuccgCfuUfuc gsusu |
| 287 | 1366 | gsasaaGfcGfGfAfccgccgucaa | 1972 | usUfsgacGfgCfGfguccGfcUfuu csusu |
| 288 | 1367 | asasagCfgGfAfCfcgccgucaca | 1973 | usGfsugaCfgGfCfggucCfgCfuu ususu |
| 289 | 1368 | asasgcGfgAfCfCfgccgucacca | 1974 | usGfsgugAfcGfGfcgguCfcGfcu ususu |
| 292 | 1369 | csgsgaCfcGfCfCfgucaccggaa | 1975 | usUfsccgGfuGfAfcggcGfgUfcc gsusu |
| 293 | 1370 | gsgsacCfgCfCfGfucaccggaua | 1976 | usAfsuccGfgUfGfacggCfgGfuc csusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 294 | 1371 | gsasccGfcCfGfUfcaccggauca | 1977 | usGfsaucCfgGfUfgacgGfcGfgucsusu |
| 295 | 1372 | ascscgCfcGfUfCfaccggaucca | 1978 | usGfsgauCfcGfGfugacGfgCfggususu |
| 296 | 1373 | cscsgcCfgUfCfAfccggauccca | 1979 | usGfsggaUfcCfGfgugaCfgGfcggsusu |
| 297 | 1374 | csgsccGfuCfAfCfcggaucccaa | 1980 | usUfsgggAfuCfCfggugAfcGfgcgsusu |
| 298 | 1375 | gscscgUfcAfCfCfggaucccaga | 1981 | usCfsuggGfaUfCfcgguGfaCfggcsusu |
| 299 | 1376 | cscsguCfaCfCfGfgaucccagaa | 1982 | usUfscugGfgAfUfccggUfgAfcggsusu |
| 300 | 1377 | csgsucAfcCfGfGfaucccagaca | 1983 | usGfsucuGfgGfAfuccgGfuGfacgsusu |
| 301 | 1378 | gsuscaCfcGfGfAfucccagacca | 1984 | usGfsgucUfgGfGfauccGfgUfgacsusu |
| 302 | 1379 | uscsacCfgGfAfUfcccagaccga | 1985 | usCfsgguCfuGfGfgaucCfgGfugasusu |
| 303 | 1380 | csasccGfgAfUfCfccagaccgca | 1986 | usGfscggUfcUfGfggauCfcGfgugsusu |
| 304 | 1381 | ascscgGfaUfCfCfcagaccgcca | 1987 | usGfsgcgGfuCfUfgggaUfcCfggususu |
| 305 | 1382 | cscsggAfuCfCfCfagaccgccca | 1988 | usGfsggcGfgUfCfugggAfuCfcggsusu |
| 306 | 1383 | csgsgaUfcCfCfAfgaccgcccua | 1989 | usAfsgggCfgGfUfcuggGfaUfccgsusu |
| 307 | 1384 | gsgsauCfcCfAfGfaccgcccuga | 1990 | usCfsaggGfcGfGfucugGfgAfuccsusu |
| 308 | 1385 | gsasucCfcAfGfAfccgcccugca | 1991 | usGfscagGfgCfGfgucuGfgGfaucsusu |
| 309 | 1386 | asusccCfaGfAfCfcgcccugcua | 1992 | usAfsgcaGfgGfCfggucUfgGfgaususu |
| 310 | 1387 | uscsccAfgAfCfCfgcccugcuca | 1993 | usGfsagcAfgGfGfcgguCfuGfggasusu |
| 311 | 1388 | cscscaGfaCfCfGfcccugcucca | 1994 | usGfsgagCfaGfGfgcggUfcUfgggsusu |
| 312 | 1389 | cscsagAfcCfGfCfccugcuccua | 1995 | usAfsggaGfcAfGfggcgGfuCfuggsusu |
| 313 | 1390 | csasgaCfcGfCfCfcugcuccuca | 1996 | usGfsaggAfgCfAfgggcGfgUfcugsusu |
| 314 | 1391 | asgsacCfgCfCfCfugcuccucca | 1997 | usGfsgagGfaGfCfagggCfgGfucususu |
| 315 | 1392 | gsasccGfcCfCfUfgcuccuccga | 1998 | usCfsggaGfgAfGfcaggGfcGfgucsusu |
| 316 | 1393 | ascscgCfcCfUfGfcuccuccgaa | 1999 | usUfscggAfgGfAfgcagGfgCfggususu |
| 325 | 1394 | csusccUfcCfGfAfgccuuugaga | 2000 | usCfsucaAfaGfGfcucgGfaGfgagsusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 328 | 1395 | csusccGfaGfCfCfuuugagaaga | 2001 | usCfsuucUfcAfAfaggcUfcGfga gsusu |
| 336 | 1396 | csusuuGfaGfAfAfggaucgcuua | 2002 | usAfsagcGfaUfCfcuucUfcAfaa gsusu |
| 337 | 1397 | ususugAfgAfAfGfgaucgcuuua | 2003 | usAfsaagCfgAfUfccuuCfuCfaa asusu |
| 338 | 1398 | ususgaGfaAfGfGfaucgcuuuca | 2004 | usGfsaaaGfcGfAfuccuUfcUfca asusu |
| 339 | 1399 | usgsagAfaGfGfAfucgcuuucca | 2005 | usGfsgaaAfgCfGfauccUfuCfuc asusu |
| 340 | 1400 | gsasgaAfgGfAfUfcgcuuuccaa | 2006 | usUfsggaAfaGfCfgaucCfuUfcu csusu |
| 341 | 1401 | asgsaaGfgAfUfCfgcuuuccaga | 2007 | usCfsuggAfaAfGfcgauCfcUfuc ususu |
| 342 | 1402 | gsasagGfaUfCfGfcuuuccagga | 2008 | usCfscugGfaAfAfgcgaUfcCfuu csusu |
| 343 | 1403 | asasggAfuCfGfCfuuuccaggca | 2009 | usGfsccuGfgAfAfagcgAfuCfcu ususu |
| 344 | 1404 | asgsgaUfcGfCfUfuuccaggcaa | 2010 | usUfsgccUfgGfAfaagcGfaUfcc ususu |
| 345 | 1405 | gsgsauCfgCfUfUfuccaggcaua | 2011 | usAfsugcCfuGfGfaaagCfgAfuc csusu |
| 346 | 1406 | gsasucGfcUfUfUfccaggcauca | 2012 | usGfsaugCfcUfGfgaaaGfcGfau csusu |
| 347 | 1407 | asuscgCfuUfUfCfcaggcaucga | 2013 | usCfsgauGfcCfUfggaaAfgCfga ususu |
| 348 | 1408 | uscsgcUfuUfCfCfaggcaucgca | 2014 | usGfscgaUfgCfCfuggaAfaGfcg asusu |
| 349 | 1409 | csgscuUfuCfCfAfggcaucgcca | 2015 | usGfsgcgAfuGfCfcuggAfaAfgc gsusu |
| 350 | 1410 | gscsuuUfcCfAfGfgcaucgccga | 2016 | usCfsggcGfaUfGfccugGfaAfag csusu |
| 351 | 1411 | csusuuCfcAfGfGfcaucgccgca | 2017 | usGfscggCfgAfUfgccuGfgAfaa gsusu |
| 352 | 1412 | ususucCfaGfGfCfaucgccgcca | 2018 | usGfsgcgGfcGfAfugccUfgGfaa asusu |
| 353 | 1413 | ususccAfgGfCfAfucgccgccca | 2019 | usGfsggcGfgCfGfaugcCfuGfga asusu |
| 369 | 1414 | cscsggGfaGfGfAfgcuggccaga | 2020 | usCfsuggCfcAfGfcuccUfcCfcg gsusu |
| 370 | 1415 | csgsggAfgGfAfGfcuggccagaa | 2021 | usUfscugGfcCfAfgcucCfuCfcc gsusu |
| 371 | 1416 | gsgsgaGfgAfGfCfuggccagaga | 2022 | usCfsucuGfgCfCfagcuCfcUfcc csusu |
| 372 | 1417 | gsgsagGfaGfCfUfggccagagaa | 2023 | usUfscucUfgGfCfcagcUfcCfuc csusu |
| 373 | 1418 | gsasggAfgCfUfGfgccagagaga | 2024 | usCfsucuCfuGfGfccagCfuCfcu csusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 374 | 1419 | asgsgaGfcUfGfGfccagagagaa | 2025 | usUfscucUfcUfGfgccaGfcUfcc ususu |
| 375 | 1420 | gsgsagCfuGfGfCfcagagagaca | 2026 | usGfsucuCfuCfUfggccAfgCfuc csusu |
| 376 | 1421 | gsasgcUfgGfCfCfagagagacga | 2027 | usCfsgucUfcUfCfuggcCfaGfcu csusu |
| 377 | 1422 | asgscuGfgCfCfAfgagagacgga | 2028 | usCfscguCfuCfUfcuggCfcAfgc ususu |
| 378 | 1423 | gscsugGfcCfAfGfagagacggga | 2029 | usCfsccgUfcUfCfucugGfcCfag csusu |
| 382 | 1424 | gscscaGfaGfAfGfacgggccuca | 2030 | usGfsaggCfcCfGfucucUfcUfgg csusu |
| 383 | 1425 | cscsagAfgAfGfAfcgggccucca | 2031 | usGfsgagGfcCfCfgucuCfuCfug gsusu |
| 384 | 1426 | csasgaGfaGfAfCfgggccuccca | 2032 | usGfsggaGfgCfCfcgucUfcUfcu gsusu |
| 385 | 1427 | asgsagAfgAfCfGfggccucccga | 2033 | usCfsgggAfgGfCfccguCfuCfuc ususu |
| 394 | 1428 | gsgsccUfcCfCfGfgaguccagga | 2034 | usCfscugGfaCfUfccggGfaGfgc csusu |
| 395 | 1429 | gscscuCfcCfGfGfaguccaggaa | 2035 | usUfsccuGfgAfCfuccgGfgAfgg csusu |
| 396 | 1430 | cscsucCfcGfGfAfguccaggaua | 2036 | usAfsuccUfgGfAfcuccGfgGfag gsusu |
| 397 | 1431 | csusccCfgGfAfGfuccaggauua | 2037 | usAfsaucCfuGfGfacucCfgGfga gsusu |
| 398 | 1432 | uscsccGfgAfGfUfccaggauuca | 2038 | usGfsaauCfcUfGfgacuCfcGfgg asusu |
| 399 | 1433 | cscscgGfaGfUfCfcaggauucaa | 2039 | usUfsgaaUfcCfUfggacUfcCfgg gsusu |
| 400 | 1434 | cscsggAfgUfCfCfaggauucaga | 2040 | usCfsugaAfuCfCfuggaCfuCfcg gsusu |
| 401 | 1435 | csgsgaGfuCfCfAfggauucagaa | 2041 | usUfscugAfaUfCfcuggAfcUfcc gsusu |
| 402 | 1436 | gsgsagUfcCfAfGfgauucagaua | 2042 | usAfsucuGfaAfUfccugGfaCfuc csusu |
| 403 | 1437 | gsasguCfcAfGfGfauucagauca | 2043 | usGfsaucUfgAfAfuccuGfgAfcu csusu |
| 404 | 1438 | asgsucCfaGfGfAfuucagaucua | 2044 | usAfsgauCfuGfAfauccUfgGfac ususu |
| 408 | 1439 | csasggAfuUfCfAfgaucugguua | 2045 | usAfsaccAfgAfUfcugaAfuCfcu gsusu |
| 409 | 1440 | asgsgaUfuCfAfGfaucugguuua | 2046 | usAfsaacCfaGfAfucugAfaUfcc ususu |
| 410 | 1441 | gsgsauUfcAfGfAfucugguuuca | 2047 | usGfsaaaCfcAfGfaucuGfaAfuc csusu |
| 411 | 1442 | gsasuuCfaGfAfUfcugguuucaa | 2048 | usUfsgaaAfcCfAfgaucUfgAfau csusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 412 | 1443 | asusucAfgAfUfCfugguuucaga | 2049 | usCfsugaAfaCfCfagauCfuGfaaususu |
| 420 | 1444 | csusggUfuUfCfAfgaaucgaaga | 2050 | usCfsuucGfaUfUfcugaAfaCfcagsusu |
| 421 | 1445 | usgsguUfuCfAfGfaaucgaagga | 2051 | usCfscuuCfgAfUfucugAfaAfccasusu |
| 422 | 1446 | gsgsuuUfcAfGfAfaucgaaggga | 2052 | usCfsccuUfcGfAfuucuGfaAfaccsusu |
| 423 | 1447 | gsusuuCfaGfAfAfucgaagggca | 2053 | usGfscccUfuCfGfauucUfgAfaacsusu |
| 424 | 1448 | ususucAfgAfAfUfcgaagggcca | 2054 | usGfsgccCfuUfCfgauuCfuGfaaasusu |
| 425 | 1449 | ususcaGfaAfUfCfgaagggccaa | 2055 | usUfsggcCfcUfUfcgauUfcUfgaasusu |
| 426 | 1450 | uscsagAfaUfCfGfaagggccaga | 2056 | usCfsuggCfcCfUfucgaUfuCfugasusu |
| 427 | 1451 | csasgaAfuCfGfAfagggccagga | 2057 | usCfscugGfcCfCfuucgAfuUfcugsusu |
| 428 | 1452 | asgsaaUfcGfAfAfgggccaggca | 2058 | usGfsccuGfgCfCfcuucGfaUfucususu |
| 429 | 1453 | gsasauCfgAfAfGfggccaggcaa | 2059 | usUfsgccUfgGfCfccuuCfgAfuucsusu |
| 430 | 1454 | asasucGfaAfGfGfgccaggcaca | 2060 | usGfsugcCfuGfGfcccuUfcGfauususu |
| 431 | 1455 | asuscgAfaGfGfGfccaggcacca | 2061 | usGfsgugCfcUfGfgcccUfuCfgaususu |
| 432 | 1456 | uscsgaAfgGfGfCfcaggcaccca | 2062 | usGfsgguGfcCfUfggccCfuUfcgasusu |
| 509 | 1457 | gsgsggUfcAfCfCfcugcucccua | 2063 | usAfsgggAfgCfAfggguGfaCfcccsusu |
| 510 | 1458 | gsgsguCfaCfCfCfugcucccuca | 2064 | usGfsaggGfaGfCfagggUfgAfcccsusu |
| 511 | 1459 | gsgsucAfcCfCfUfgcucccucga | 2065 | usCfsgagGfgAfGfcaggGfuGfaccsusu |
| 512 | 1460 | gsuscaCfcCfUfGfcucccucgua | 2066 | usAfscgaGfgGfAfgcagGfgUfgacsusu |
| 513 | 1461 | uscsacCfcUfGfCfucccucguga | 2067 | usCfsacgAfgGfGfagcaGfgGfugasusu |
| 514 | 1462 | csascccCfuGfCfUfcccucgugga | 2068 | usCfscacGfaGfGfgagcAfgGfgugsusu |
| 516 | 1463 | cscscuGfcUfCfCfcucgugggua | 2069 | usAfscccAfcGfAfgggaGfcAfgggsusu |
| 517 | 1464 | cscsugCfuCfCfCfucgugggguca | 2070 | usGfsaccCfaCfGfagggAfgCfaggsusu |
| 518 | 1465 | csusgcUfcCfCfUfcgugggucga | 2071 | usCfsgacCfcAfCfgaggGfaGfcagsusu |
| 519 | 1466 | usgscuCfcCfUfCfgugggucgca | 2072 | usGfscgaCfcCfAfcgagGfgAfgcasusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 520 | 1467 | gscsucCfcUfCfGfugggucgcca | 2073 | usGfsgcgAfcCfCfacgaGfgGfag csusu |
| 521 | 1468 | csusccCfuCfGfUfgggucgccua | 2074 | usAfsggcGfaCfCfcacgAfgGfga gsusu |
| 522 | 1469 | uscsccUfcGfUfGfggucgccuua | 2075 | usAfsaggCfgAfCfccacGfaGfgg asusu |
| 523 | 1470 | cscscuCfgUfGfGfgucgccuuca | 2076 | usGfsaagGfcGfAfcccaCfgAfgg gsusu |
| 524 | 1471 | cscsucGfuGfGfGfucgccuucga | 2077 | usCfsgaaGfgCfGfacccAfcGfag gsusu |
| 525 | 1472 | csuscgUfgGfGfUfcgccuucgca | 2078 | usGfscgaAfgGfCfgaccCfaCfga gsusu |
| 526 | 1473 | uscsguGfgGfUfCfgccuucgcca | 2079 | usGfsgcgAfaGfGfcgacCfcAfcg asusu |
| 530 | 1474 | gsgsguCfgCfCfUfucgcccacaa | 2080 | usUfsgugGfgCfGfaaggCfgAfcc csusu |
| 531 | 1475 | gsgsucGfcCfUfUfcgcccacaca | 2081 | usGfsuguGfgGfCfgaagGfcGfac csusu |
| 532 | 1476 | gsuscgCfcUfUfCfgcccacacca | 2082 | usGfsgugUfgGfGfcgaaGfgCfga csusu |
| 533 | 1477 | uscsgcCfuUfCfGfcccacaccga | 2083 | usCfsgguGfuGfGfgcgaAfgGfcg asusu |
| 544 | 1478 | csascaCfcGfGfCfgcguggggaa | 2084 | usUfsccccCfaCfGfcgccGfgUfgu gsusu |
| 545 | 1479 | ascsacCfgGfCfGfcguggggaaa | 2085 | usUfsuccCfcAfCfgcgcCfgGfug ususu |
| 552 | 1480 | csgscgUfgGfGfGfaacggggcua | 2086 | usAfsgccCfcGfUfucccCfaCfgc gsusu |
| 553 | 1481 | gscsguGfgGfGfAfacggggcuua | 2087 | usAfsagcCfcCfGfuuccCfcAfcg csusu |
| 566 | 1482 | gsgscuUfcCfCfGfcaccccacga | 2088 | usCfsgugGfgGfUfgcggGfaAfgc csusu |
| 567 | 1483 | gscsuuCfcCfGfCfaccccacgua | 2089 | usAfscguGfgGfGfugcgGfgAfag csusu |
| 619 | 1484 | ususcgUfgAfGfCfcaggcagcga | 2090 | usCfsgcuGfcCfUfggcuCfaCfga asusu |
| 620 | 1485 | uscsguGfaGfCfCfaggcagcgaa | 2091 | usUfscgcUfgCfCfuggcUfcAfcg asusu |
| 621 | 1486 | csgsugAfgCfCfAfggcagcgaga | 2092 | usCfsucgCfuGfCfcuggCfuCfac gsusu |
| 622 | 1487 | gsusgaGfcCfAfGfgcagcgagga | 2093 | usCfscucGfcUfGfccugGfcUfca csusu |
| 671 | 1488 | csgsccGfgCfAfGfaggggaucua | 2094 | usAfsgauCfcCfCfucugCfcGfgc gsusu |
| 672 | 1489 | gscscgGfcAfGfAfggggaucuca | 2095 | usGfsagaUfcCfCfcucuGfcCfgg csusu |
| 673 | 1490 | cscsggCfaGfAfGfgggaucucca | 2096 | usGfsgagAfuCfCfccucUfgCfcg gsusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 674 | 1491 | csgsgcAfgAfGfGfggaucuccca | 2097 | usGfsggaGfaUfCfcccuCfuGfcc gsusu |
| 675 | 1492 | gsgscaGfaGfGfGfgaucucccaa | 2098 | usUfsgggAfgAfUfccccUfcUfgc csusu |
| 683 | 1493 | gsgsauCfuCfCfCfaaccugccca | 2099 | usGfsggcAfgGfUfugggAfgAfuc csusu |
| 684 | 1494 | gsasucUfcCfCfAfaccugcccca | 2100 | usGfsgggCfaGfGfuuggGfaGfau csusu |
| 685 | 1495 | asuscuCfcCfAfAfccugccccga | 2101 | usCfsgggGfcAfGfguugGfgAfga ususu |
| 686 | 1496 | uscsucCfcAfAfCfcugccccgga | 2102 | usCfscggGfgCfAfgguuGfgGfag asusu |
| 706 | 1497 | csgscgGfgGfAfUfuucgccuaca | 2103 | usGfsuagGfcGfAfaaucCfcCfgc gsusu |
| 707 | 1498 | gscsggGfgAfUfUfucgccuacga | 2104 | usCfsguaGfgCfGfaaauCfcCfcg csusu |
| 708 | 1499 | csgsggGfaUfUfUfcgccuacgca | 2105 | usGfscguAfgGfCfgaaaUfcCfcc gsusu |
| 709 | 1500 | gsgsggAfuUfUfCfgccuacgcca | 2106 | usGfsgcgUfaGfGfcgaaAfuCfcc csusu |
| 710 | 1501 | gsgsgaUfuUfCfGfccuacgccga | 2107 | usCfsggcGfuAfGfgcgaAfaUfcc csusu |
| 711 | 1502 | gsgsauUfuCfGfCfcuacgccgca | 2108 | usGfscggCfgUfAfggcgAfaAfuc csusu |
| 712 | 1503 | gsasuuUfcGfCfCfuacgccgcca | 2109 | usGfsgcgGfcGfUfaggcGfaAfau csusu |
| 713 | 1504 | asusuuCfgCfCfUfacgccgccca | 2110 | usGfsggcGfgCfGfuaggCfgAfaa ususu |
| 714 | 1505 | ususucGfcCfUfAfcgccgcccca | 2111 | usGfsgggCfgGfCfguagGfcGfaa asusu |
| 746 | 1506 | gsgsgcGfcUfCfUfcccacccuca | 2112 | usGfsaggGfuGfGfgagaGfcGfcc csusu |
| 747 | 1507 | gsgscgCfuCfUfCfccacccucaa | 2113 | usUfsgagGfgUfGfggagAfgCfgc csusu |
| 748 | 1508 | gscsgcUfcUfCfCfcacccucaga | 2114 | usCfsugaGfgGfUfgggaGfaGfcg csusu |
| 749 | 1509 | csgscuCfuCfCfCfacccucagga | 2115 | usCfscugAfgGfGfugggAfgAfgc gsusu |
| 750 | 1510 | gscsucUfcCfCfAfcccucaggca | 2116 | usGfsccuGfaGfGfguggGfaGfag csusu |
| 751 | 1511 | csuscuCfcCfAfCfccucaggcua | 2117 | usAfsgccUfgAfGfggugGfgAfga gsusu |
| 752 | 1512 | uscsucCfcAfCfCfcucaggcuca | 2118 | usGfsagcCfuGfAfggguGfgGfag asusu |
| 753 | 1513 | csusccCfaCfCfCfucaggcucca | 2119 | usGfsgagCfcUfGfagggUfgGfga gsusu |
| 754 | 1514 | uscsccAfcCfCfUfcaggcuccua | 2120 | usAfsggaGfcCfUfgaggGfuGfgg asusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 755 | 1515 | cscscaCfcCfUfCfaggcuccuca | 2121 | usGfsaggAfgCfCfugagGfgUfgg gsusu |
| 756 | 1516 | cscsacCfcUfCfAfggcuccucga | 2122 | usCfsgagGfaGfCfcugaGfgGfug gsusu |
| 757 | 1517 | csasccCfuCfAfGfgcuccucgga | 2123 | usCfscgaGfgAfGfccugAfgGfgu gsusu |
| 758 | 1518 | ascsccUfcAfGfGfcuccucggua | 2124 | usAfsccgAfgGfAfgccuGfaGfgg ususu |
| 759 | 1519 | cscscuCfaGfGfCfuccucgguga | 2125 | usCfsaccGfaGfGfagccUfgAfgg gsusu |
| 760 | 1520 | cscsucAfgGfCfUfccucggugga | 2126 | usCfscacCfgAfGfgagcCfuGfag gsusu |
| 761 | 1521 | csuscaGfgCfUfCfcucgguggca | 2127 | usGfsccaCfcGfAfggagCfcUfga gsusu |
| 767 | 1522 | csusccUfcGfGfUfggccuccgca | 2128 | usGfscggAfgGfCfcaccGfaGfga gsusu |
| 768 | 1523 | uscscuCfgGfUfGfgccuccgcaa | 2129 | usUfsgcgGfaGfGfccacCfgAfgg asusu |
| 777 | 1524 | gscscuCfcGfCfAfcccgggcaaa | 2130 | usUfsugcCfcGfGfgugcGfgAfgg csusu |
| 778 | 1525 | cscsucCfgCfAfCfccgggcaaaa | 2131 | usUfsuugCfcCfGfggugCfgGfag gsusu |
| 779 | 1526 | csusccGfcAfCfCfcgggcaaaaa | 2132 | usUfsuuuGfcCfCfggguGfcGfga gsusu |
| 780 | 1527 | uscscgCfaCfCfCfgggcaaaaga | 2133 | usCfsuuuUfgCfCfcgggUfgCfgg asusu |
| 781 | 1528 | cscsgcAfcCfCfGfggcaaaagca | 2134 | usGfscuuUfuGfCfccggGfuGfcg gsusu |
| 782 | 1529 | csgscaCfcCfGfGfgcaaaagcca | 2135 | usGfsgcuUfuUfGfcccgGfgUfgc gsusu |
| 788 | 1530 | csgsggCfaAfAfAfgccgggagga | 2136 | usCfscucCfcGfGfcuuuUfgCfcc gsusu |
| 789 | 1531 | gsgsgcAfaAfAfGfccgggaggaa | 2137 | usUfsccuCfcCfGfgcuuUfuGfcc csusu |
| 790 | 1532 | gsgscaAfaAfGfCfcgggaggaca | 2138 | usGfsuccUfcCfCfggcuUfuUfgc csusu |
| 791 | 1533 | gscsaaAfaGfCfCfgggaggacca | 2139 | usGfsgucCfuCfCfcggcUfuUfug csusu |
| 840 | 1534 | csusgcGfcGfGfUfggcacagcca | 2140 | usGfsgcuGfuGfCfcaccGfcGfca gsusu |
| 841 | 1535 | usgscgCfgGfUfGfgcacagccua | 2141 | usAfsggcUfgUfGfccacCfgCfgc asusu |
| 851 | 1536 | csascaGfcCfUfGfggcccgcuca | 2142 | usGfsagcGfgGfCfccagGfcUfgu gsusu |
| 852 | 1537 | ascsagCfcUfGfGfgcccgcucaa | 2143 | usUfsgagCfgGfGfcccaGfgCfug ususu |
| 853 | 1538 | csasgcCfuGfGfGfcccgcucaaa | 2144 | usUfsugaGfcGfGfgcccAfgGfcu gsusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 854 | 1539 | asgsccUfgGfGfCfccgcucaaga | 2145 | usCfsuugAfgCfGfggccCfaGfgc usu su |
| 878 | 1540 | csgscaGfgGfCfCfaaggggugca | 2146 | usGfscacCfcCfUfuggcCfcUfgc gsusu |
| 879 | 1541 | gscsagGfgCfCfAfaggggugcua | 2147 | usAfsgcaCfcCfCfuuggCfcCfug csusu |
| 901 | 1542 | cscsacCfcAfCfGfucccagggga | 2148 | usCfsccccUfgGfGfacguGfgGfug gsusu |
| 902 | 1543 | csasccCfaCfGfUfcccaggggaa | 2149 | usUfsccccCfuGfGfgacgUfgGfgu gsusu |
| 903 | 1544 | ascsccAfcGfUfCfccaggggaga | 2150 | usCfsuccCfcUfGfggacGfuGfgg usu su |
| 911 | 1545 | cscscaGfgGfGfAfguccguggua | 2151 | usAfsccaCfgGfAfcuccCfcUfgg gsusu |
| 912 | 1546 | cscsagGfgGfAfGfuccguggaga | 2152 | usCfsaccAfcGfGfacucCfcCfug gsusu |
| 913 | 1547 | csasggGfgAfGfUfccguggugga | 2153 | usCfscacCfaCfGfgacuCfcCfcu gsusu |
| 914 | 1548 | asgsggGfaGfUfCfcguggugga | 2154 | usCfsccaCfcAfCfggacUfcCfcc usu su |
| 960 | 1549 | gsgscgGfcGfUfGfggaaccccaa | 2155 | usUfsgggGfuUfCfccacGfcCfgc csusu |
| 975 | 1550 | cscsaaGfcCfGfGfggcagcucca | 2156 | usGfsgagCfuGfCfcccgGfcUfug gsusu |
| 976 | 1551 | csasagCfcGfGfGfgcagcuccaa | 2157 | usUfsggaGfcUfGfccccGfgCfuu gsusu |
| 977 | 1552 | asasgcCfgGfGfGfcagcuccaca | 2158 | usGfsuggAfgCfUfgcccCfgGfcu usu su |
| 983 | 1553 | gsgsgcAfgCfUfCfcaccuccccca | 2159 | usGfsgggAfgGfUfggagCfuGfcc csusu |
| 984 | 1554 | gsgscaGfcUfCfCfaccuccccaa | 2160 | usUfsgggGfaGfGfuggaGfcUfgc csusu |
| 985 | 1555 | gscsagCfuCfCfAfccuccccaga | 2161 | usCfsuggGfgAfGfguggAfgCfug csusu |
| 986 | 1556 | csasgcUfcCfAfCfcuccccagca | 2162 | usGfscugGfgGfAfggugGfaGfcu gsusu |
| 1031 | 1557 | csgscgGfcAfGfGfggcagaugca | 2163 | usGfscauCfuGfCfccccuGfcCfgc gsusu |
| 1033 | 1558 | csgsgcAfgGfGfGfcagaugcaaa | 2164 | usUfsugcAfuCfUfgcccCfuGfcc gsusu |
| 1034 | 1559 | gsgscaGfgGfGfCfagaugcaaga | 2165 | usCfsuugCfaUfCfugccCfcUfgc csusu |
| 1035 | 1560 | gscsagGfgGfCfAfgaugcaagga | 2166 | usCfscuuGfcAfUfcugcCfcCfug csusu |
| 1036 | 1561 | csasggGfgCfAfGfaugcaaggca | 2167 | usGfsccuUfgCfAfucugCfcCfcu gsusu |
| 1037 | 1562 | asgsggGfcAfGfAfugcaaggcaa | 2168 | usUfsgccUfuGfCfaucuGfcCfcc usu su |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1046 | 1563 | usgscaAfgGfCfAfucccggcgca | 2169 | usGfscgcCfgGfGfaugcCfuUfgc asusu |
| 1048 | 1564 | csasagGfcAfUfCfccggcgccca | 2170 | usGfsggcGfcCfGfggauGfcCfuu gsusu |
| 1049 | 1565 | asasggCfaUfCfCfcggcgcccua | 2171 | usAfsgggCfgCfCfgggaUfgCfcu ususu |
| 1064 | 1566 | cscsucCfcAfGfGfcgcuccagga | 2172 | usCfscugGfaGfCfgccuGfgGfag gsusu |
| 1086 | 1567 | gsgscgCfcCfUfGfgucugcacua | 2173 | usAfsgugCfaGfAfccagGfgCfgc csusu |
| 1087 | 1568 | gscsgcCfcUfGfGfucugcacuca | 2174 | usGfsaguGfcAfGfaccaGfgGfcg csusu |
| 1088 | 1569 | csgsccCfuGfGfUfcugcacucca | 2175 | usGfsgagUfgCfAfgaccAfgGfgc gsusu |
| 1089 | 1570 | gscsccUfgGfUfCfugcacuccca | 2176 | usGfsggaGfuGfCfagacCfaGfgg csusu |
| 1090 | 1571 | cscscuGfgUfCfUfgcacucccca | 2177 | usGfsgggAfgUfGfcagaCfcAfgg gsusu |
| 1091 | 1572 | cscsugGfuCfUfGfcacuccccua | 2178 | usAfsgggGfaGfUfgcagAfcCfag gsusu |
| 1092 | 1573 | csusggUfcUfGfCfacuccccuga | 2179 | usCfsaggGfgAfGfugcaGfaCfca gsusu |
| 1093 | 1574 | usgsguCfuGfCfAfcuccccugca | 2180 | usGfscagGfgGfAfgugcAfgAfcc asusu |
| 1094 | 1575 | gsgsucUfgCfAfCfuccccugcga | 2181 | usCfsgcaGfgGfGfagugCfaGfac csusu |
| 1095 | 1576 | gsuscuGfcAfCfUfccccugcgga | 2182 | usCfscgcAfgGfGfgaguGfcAfga csusu |
| 1096 | 1577 | uscsugCfaCfUfCfcccugcggca | 2183 | usGfsccgCfaGfGfggagUfgCfag asusu |
| 1097 | 1578 | csusgcAfcUfCfCfccugcggcca | 2184 | usGfsgccGfcAfGfgggaGfuGfca gsusu |
| 1098 | 1579 | usgscaCfuCfCfCfcugcggccua | 2185 | usAfsggcCfgCfAfggggAfgUfgc asusu |
| 1100 | 1580 | csascuCfcCfCfUfgcggccugca | 2186 | usGfscagGfcCfGfcaggGfgAfgu gsusu |
| 1101 | 1581 | ascsucCfcCfUfGfcggccugcua | 2187 | usAfsgcaGfgCfCfgcagGfgGfag ususu |
| 1103 | 1582 | uscsccCfuGfCfGfgccugcugca | 2188 | usGfscagCfaGfGfccgcAfgGfgg asusu |
| 1106 | 1583 | cscsugCfgGfCfCfugcugcugga | 2189 | usCfscagCfaGfCfaggcCfgCfag gsusu |
| 1107 | 1584 | csusgcGfgCfCfUfgcugcuggaa | 2190 | usUfsccaGfcAfGfcaggCfcGfca gsusu |
| 1108 | 1585 | usgscgGfcCfUfGfcugcuggaua | 2191 | usAfsuccAfgCfAfgcagGfcCfgc asusu |
| 1109 | 1586 | gscsggCfcUfGfCfugcuggauga | 2192 | usCfsaucCfaGfCfagcaGfgCfcg csusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1110 | 1587 | csgsgcCfuGfCfUfgcuggaugaa | 2193 | usUfscauCfcAfGfcagcAfgGfcc gsusu |
| 1111 | 1588 | gsgsccUfgCfUfGfcuggaugaga | 2194 | usCfsucaUfcCfAfgcagCfaGfgc csusu |
| 1112 | 1589 | gscscuGfcUfGfCfuggaugagca | 2195 | usGfscucAfuCfCfagcaGfcAfgg csusu |
| 1113 | 1590 | cscsugCfuGfCfUfggaugagcua | 2196 | usAfsgcuCfaUfCfcagcAfgCfag gsusu |
| 1114 | 1591 | csusgcUfgCfUfGfgaugagcuca | 2197 | usGfsagcUfcAfUfccagCfaGfca gsusu |
| 1115 | 1592 | usgscuGfcUfGfGfaugagcucca | 2198 | usGfsgagCfuCfAfuccaGfcAfgc asusu |
| 1116 | 1593 | gscsugCfuGfGfAfugagcuccua | 2199 | usAfsggaGfcUfCfauccAfgCfag csusu |
| 1117 | 1594 | csusgcUfgGfAfUfgagcuccuga | 2200 | usCfsaggAfgCfUfcaucCfaGfca gsusu |
| 1118 | 1595 | usgscuGfgAfUfGfagcuccugga | 2201 | usCfscagGfaGfCfucauCfcAfgc asusu |
| 1119 | 1596 | gscsugGfaUfGfAfgcuccuggca | 2202 | usGfsccaGfgAfGfcucaUfcCfag csusu |
| 1130 | 1597 | uscscuGfgCfGfAfgcccggagua | 2203 | usAfscucCfgGfGfcucgCfcAfgg asusu |
| 1131 | 1598 | cscsugGfcGfAfGfcccggaguua | 2204 | usAfsacuCfcGfGfgcucGfcCfag gsusu |
| 1132 | 1599 | csusggCfgAfGfCfccggaguuua | 2205 | usAfsaacUfcCfGfggcuCfgCfca gsusu |
| 1137 | 1600 | gsasgcCfcGfGfAfguuucugcaa | 2206 | usUfsgcaGfaAfAfcuccGfgGfcu csusu |
| 1138 | 1601 | asgsccCfgGfAfGfuuucugcaga | 2207 | usCfsugcAfgAfAfacucCfgGfgc ususu |
| 1139 | 1602 | gscsccGfgAfGfUfuucugcagca | 2208 | usGfscugCfaGfAfaacuCfcGfgg csusu |
| 1140 | 1603 | cscscgGfaGfUfUfucugcagcaa | 2209 | usUfsgcuGfcAfGfaaacUfcCfgg gsusu |
| 1141 | 1604 | cscsggAfgUfUfUfcugcagcaga | 2210 | usCfsugcUfgCfAfgaaaCfuCfcg gsusu |
| 1142 | 1605 | csgsgaGfuUfUfCfugcagcagga | 2211 | usCfscugCfuGfCfagaaAfcUfcc gsusu |
| 1143 | 1606 | gsgsagUfuUfCfUfgcagcaggca | 2212 | usGfsccuGfcUfGfcagaAfaCfuc csusu |
| 1144 | 1607 | gsasguUfuCfUfGfcagcaggcga | 2213 | usCfsgccUfgCfUfgcagAfaAfcu csusu |
| 1145 | 1608 | asgsuuUfcUfGfCfagcaggcgca | 2214 | usGfscgcCfuGfCfugcaGfaAfac ususu |
| 1146 | 1609 | gsusuuCfuGfCfAfgcaggcgcaa | 2215 | usUfsgcgCfcUfGfcugcAfgAfaa csusu |
| 1147 | 1610 | ususucUfgCfAfGfcaggcgcaaa | 2216 | usUfsugcGfcCfUfgcugCfaGfaa asusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1148 | 1611 | ususcuGfcAfGfCfaggcgcaaca | 2217 | usGfsuugCfgCfCfugcuGfcAfgaasusu |
| 1149 | 1612 | uscsugCfaGfCfAfggcgcaacca | 2218 | usGfsguuGfcGfCfcugcUfgCfagasusu |
| 1150 | 1613 | csusgcAfgCfAfGfgcgcaaccua | 2219 | usAfsgguUfgCfGfccugCfuGfcagsusu |
| 1151 | 1614 | usgscaGfcAfGfGfcgcaaccuca | 2220 | usGfsaggUfuGfCfgccuGfcUfgcasusu |
| 1152 | 1615 | gscsagCfaGfGfCfgcaaccucua | 2221 | usAfsgagGfuUfGfcgccUfgCfugcsusu |
| 1153 | 1616 | csasgcAfgGfCfGfcaaccucuca | 2222 | usGfsagaGfgUfUfgcgcCfuGfcugsusu |
| 1154 | 1617 | asgscaGfgCfGfCfaaccucucca | 2223 | usGfsgagAfgGfUfugcgCfcUfgcusus u |
| 1155 | 1618 | gscsagGfcGfCfAfaccucuccua | 2224 | usAfsggaGfaGfGfuugcGfcCfugcsusu |
| 1156 | 1619 | csasggCfgCfAfAfccucuccuaa | 2225 | usUfsaggAfgAfGfguugCfgCfcugsusu |
| 1157 | 1620 | asgsgcGfcAfAfCfcucuccuaga | 2226 | usCfsuagGfaGfAfgguuGfcGfccusus u |
| 1158 | 1621 | gsgscgCfaAfCfCfucuccuagaa | 2227 | usUfscuaGfgAfGfagguUfgCfgccsusu |
| 1159 | 1622 | gscsgcAfaCfCfUfcuccuagaaa | 2228 | usUfsucuAfgGfAfgaggUfuGfcgcsusu |
| 1160 | 1623 | csgscaAfcCfUfCfuccuagaaaa | 2229 | usUfsuucUfaGfGfagagGfuUfgcgsusu |
| 1161 | 1624 | gscsaaCfcUfCfUfccuagaaaca | 2230 | usGfsuuuCfuAfGfgagaGfgUfugcsusu |
| 1162 | 1625 | csasacCfuCfUfCfcuagaaacga | 2231 | usCfsguuUfcUfAfggagAfgGfuugsusu |
| 1163 | 1626 | asasccUfcUfCfCfuagaaacgga | 2232 | usCfscguUfuCfUfaggaGfaGfguusus u |
| 1169 | 1627 | uscscuAfgAfAfAfcggaggccca | 2233 | usGfsggcCfuCfCfguuuCfuAfggasusu |
| 1170 | 1628 | cscsuaGfaAfAfCfggaggcccca | 2234 | usGfsgggCfcUfCfcguuUfcUfaggsusu |
| 1171 | 1629 | csusagAfaAfCfGfgaggccccga | 2235 | usCfsgggGfcCfUfccguUfuCfuagsusu |
| 1428 | 1630 | cscsggUfgAfGfAfgacuccacua | 2236 | usAfsgugGfaGfUfcucuCfaCfcggsusu |
| 1429 | 1631 | csgsguGfaGfAfGfacuccacuca | 2237 | usGfsaguGfgAfGfucucUfcAfccgsusu |
| 1430 | 1632 | gsgsugAfgAfGfAfcuccacucca | 2238 | usGfsgagUfgGfAfgucuCfuCfaccsusu |
| 1570 | 1633 | cscscuUfgUfUfCfuuccgugaaa | 2239 | usUfsucaCfgGfAfagaaCfaAfgggsusu |
| 1571 | 1634 | cscsuuGfuUfCfUfuccgugaaaa | 2240 | usUfsuucAfcGfGfaagaAfcAfaggsusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1572 | 1635 | csusugUfuCfUfUfccgugaaaua | 2241 | usAfsuuuCfaCfGfgaagAfaCfaagsusu |
| 1573 | 1636 | ususguUfcUfUfCfcgugaaauua | 2242 | usAfsauuUfcAfCfggaaGfaAfcaasusu |
| 1574 | 1637 | usgsuuCfuUfCfCfgugaaauuca | 2243 | usGfsaauUfuCfAfcggaAfgAfacasusu |
| 1575 | 1638 | gsusucUfuCfCfGfugaaauucua | 2244 | usAfsgaaUfuUfCfacggAfaGfaacsusu |
| 1576 | 1639 | ususcuUfcCfGfUfgaaauucuga | 2245 | usCfsagaAfuUfUfcacgGfaAfgaasusu |
| 1577 | 1640 | uscsuuCfcGfUfGfaaauucugga | 2246 | usCfscagAfaUfUfucacGfgAfagasusu |
| 1578 | 1641 | csusucCfgUfGfAfaauucuggca | 2247 | usGfsccaGfaAfUfuucaCfgGfaagsusu |
| 1589 | 1642 | ususcuGfgCfUfGfaaugucucca | 2248 | usGfsgagAfcAfUfucagCfcAfgaasusu |
| 1590 | 1643 | uscsugGfcUfGfAfaugucuccca | 2249 | usGfsggaGfaCfAfuucaGfcCfagasusu |
| 1618 | 1644 | gsascgCfuGfUfCfuaggcaaaca | 2250 | usGfsuuuGfcCfUfagacAfgCfgucsusu |
| 1619 | 1645 | ascsgcUfgUfCfUfaggcaaacca | 2251 | usGfsguuUfgCfCfuagaCfaGfcgususu |
| 1620 | 1646 | csgscuGfuCfUfAfggcaaaccua | 2252 | usAfsgguUfuGfCfcuagAfcAfgcgsusu |
| 1621 | 1647 | gscsugUfcUfAfGfgcaaaccuga | 2253 | usCfsaggUfuUfGfccuaGfaCfagcsusu |
| 1622 | 1648 | csusguCfuAfGfGfcaaaccugga | 2254 | usCfscagGfuUfUfgccuAfgAfcagsusu |
| 1623 | 1649 | usgsucUfaGfGfCfaaaccuggaa | 2255 | usUfsccaGfgUfUfugccUfaGfacasusu |
| 1624 | 1650 | gsuscuAfgGfCfAfaaccuggaua | 2256 | usAfsuccAfgGfUfuugcCfuAfgacsusu |
| 1625 | 1651 | uscsuaGfgCfAfAfaccuggauua | 2257 | usAfsaucCfaGfGfuuugCfcUfagasusu |
| 1626 | 1652 | csusagGfcAfAfAfccuggauuaa | 2258 | usUfsaauCfcAfGfguuuGfcCfuagsusu |
| 1627 | 1653 | usasggCfaAfAfCfcuggauuaga | 2259 | usCfsuaaUfcCfAfgguuUfgCfcuasusu |
| 1628 | 1654 | asgsgcAfaAfCfCfuggauuagaa | 2260 | usUfscuaAfuCfCfagguUfuGfccususu |
| 1629 | 1655 | gsgscaAfaCfCfUfggauuagaga | 2261 | usCfsucuAfaUfCfcaggUfuUfgccsusu |
| 1630 | 1656 | gscsaaAfcCfUfGfgauuagagua | 2262 | usAfscucUfaAfUfccagGfuUfugcsusu |
| 1631 | 1657 | csasaaCfcUfGfGfauuagaguua | 2263 | usAfsacuCfuAfAfuccaGfgUfuugsusu |
| 1632 | 1658 | asasacCfuGfGfAfuuagaguuaa | 2264 | usUfsaacUfcUfAfauccAfgGfuuususu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1633 | 1659 | asasccUfgGfAfUfuagaguuaca | 2265 | usGfsuaaCfuCfUfaaucCfaGfgu ususu |
| 1634 | 1660 | ascscuGfgAfUfUfagaguuacaa | 2266 | usUfsguaAfcUfCfuaauCfcAfgg ususu |
| 1635 | 1661 | cscsugGfaUfUfAfgaguuacaua | 2267 | usAfsuguAfaCfUfcuaaUfcCfag gsusu |
| 1636 | 1662 | csusggAfuUfAfGfaguuacauca | 2268 | usGfsaugUfaAfCfucuaAfuCfca gsusu |
| 1637 | 1663 | usgsgaUfuAfGfAfguuacaucua | 2269 | usAfsgauGfuAfAfcucuAfaUfcc asusu |
| 1638 | 1664 | gsgsauUfaGfAfGfuuacaucuca | 2270 | usGfsagaUfgUfAfacucUfaAfuc csusu |
| 1639 | 1665 | gsasuuAfgAfGfUfuacaucucca | 2271 | usGfsgagAfuGfUfaacuCfuAfau csusu |
| 1640 | 1666 | asusuaGfaGfUfUfacaucuccua | 2272 | usAfsggaGfaUfGfuaacUfcUfaa ususu |
| 1641 | 1667 | ususagAfgUfUfAfcaucuccuga | 2273 | usCfsaggAfgAfUfguaaCfuCfua asusu |
| 1642 | 1668 | usasgaGfuUfAfCfaucuccugga | 2274 | usCfscagGfaGfAfuguaAfcUfcu asusu |
| 1643 | 1669 | asgsagUfuAfCfAfucuccuggaa | 2275 | usUfsccaGfgAfGfauguAfaCfuc ususu |
| 1651 | 1670 | asuscuCfcUfGfGfaugauuagua | 2276 | usAfscuaAfuCfAfuccaGfgAfga ususu |
| 1652 | 1671 | uscsucCfuGfGfAfugauuaguua | 2277 | usAfsacuAfaUfCfauccAfgGfag asusu |
| 1653 | 1672 | csusccUfgGfAfUfgauuaguuca | 2278 | usGfsaacUfaAfUfcaucCfaGfga gsusu |
| 1654 | 1673 | uscscuGfgAfUfGfauuaguucaa | 2279 | usUfsgaaCfuAfAfucauCfcAfgg asusu |
| 1655 | 1674 | cscsugGfaUfGfAfuuaguucaga | 2280 | usCfsugaAfcUfAfaucaUfcCfag gsusu |
| 1656 | 1675 | csusggAfuGfAfUfuaguucagaa | 2281 | usUfscugAfaCfUfaaucAfuCfca gsusu |
| 26 | 1676 | gscsacCfcUfCfCfccgcggaaga | 2282 | usCfsuucCfgCfGfgggaGfgGfug csusu |
| 27 | 1677 | csasccCfuCfCfCfcgcggaagca | 2283 | usGfscuuCfcGfCfggggAfgGfgu gsusu |
| 28 | 1678 | ascsccUfcCfCfCfgcggaagcca | 2284 | usGfsgcuUfcCfGfcgggGfaGfgg ususu |
| 30 | 1679 | cscsucCfcCfGfCfggaagcccga | 2285 | usCfsgggCfuUfCfcgcgGfgGfag gsusu |
| 35 | 1680 | cscsgcGfgAfAfGfcccggggaca | 2286 | usGfsuccCfcGfGfgcuuCfcGfcg gsusu |
| 37 | 1681 | gscsggAfaGfCfCfcggggacgaa | 2287 | usUfscguCfcCfCfgggcUfuCfcg csusu |
| 38 | 1682 | csgsgaAfgCfCfCfggggacgaga | 2288 | usCfsucgUfcCfCfcgggCfuUfcc gsusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 193 | 1683 | asusuuGfgUfUfUfcagaaugaga | 2289 | usCfsucaUfuCfUfgaaaCfcAfaa ususu |
| 233 | 1684 | ascscgGfcGfGfGfaaucucggca | 2290 | usGfsccgAfgAfUfucccGfcCfgg ususu |
| 250 | 1685 | cscscuGfgCfCfCfgggagacgca | 2291 | usGfscguCfuCfCfcgggCfcAfgg gsusu |
| 251 | 1686 | cscsugGfcCfCfGfggagacgcga | 2292 | usCfsgcgUfcUfCfccggGfcCfag gsusu |
| 252 | 1687 | csusggCfcCfGfGfgagacgcgga | 2293 | usCfscgcGfuCfUfcccgGfgCfca gsusu |
| 263 | 1688 | gsascgCfgGfCfCfcgccagaaga | 2294 | usCfsuucUfgGfCfgggcCfgCfgu csusu |
| 264 | 1689 | ascsgcGfgCfCfCfgccagaagga | 2295 | usCfscuuCfuGfGfcgggCfcGfcg ususu |
| 279 | 1690 | asgsgcCfgGfCfGfaaagcggaca | 2296 | usGfsuccGfcUfUfucgcCfgGfcc ususu |
| 280 | 1691 | gsgsccGfgCfGfAfaagcggacca | 2297 | usGfsgucCfgCfUfuucgCfcGfgc csusu |
| 281 | 1692 | gscscgGfcGfAfAfagcggaccga | 2298 | usCfsgguCfcGfCfuuucGfcCfgg csusu |
| 317 | 1693 | cscsgcCfcUfGfCfuccuccgaga | 2299 | usCfsucgGfaGfGfagcaGfgGfcg gsusu |
| 355 | 1694 | cscsagGfcAfUfCfgccgcccgga | 2300 | usCfscggGfcGfGfcgauGfcCfug gsusu |
| 359 | 1695 | gscsauCfgCfCfGfcccgggagga | 2301 | usCfscucCfcGfGfgcggCfgAfug csusu |
| 360 | 1696 | csasucGfcCfGfCfccgggaggaa | 2302 | usUfsccuCfcCfGfggcgGfcGfau gsusu |
| 361 | 1697 | asuscgCfcGfCfCfcgggaggaga | 2303 | usCfsuccUfcCfCfgggcGfgCfga ususu |
| 362 | 1698 | uscsgcCfgCfCfCfgggaggagca | 2304 | usGfscucCfuCfCfcgggCfgGfcg asusu |
| 363 | 1699 | csgsccGfcCfCfGfggaggagcua | 2305 | usAfsgcuCfcUfCfccggGfcGfgc gsusu |
| 437 | 1700 | gsgsgcCfaGfGfCfacccgggaca | 2306 | usGfsuccCfgGfGfugccUfgGfcc csusu |
| 452 | 1701 | gsascaGfgGfUfGfgcagggcgca | 2307 | usGfscgcCfcUfGfccacCfcUfgu csusu |
| 453 | 1702 | ascsagGfgUfGfGfcagggcgcca | 2308 | usGfsgcgCfcCfUfgccaCfcCfug ususu |
| 455 | 1703 | asgsggUfgGfCfAfgggcgcccga | 2309 | usCfsgggCfgCfCfcugcCfaCfcc ususu |
| 456 | 1704 | gsgsguGfgCfAfGfggcgcccgca | 2310 | usGfscggGfcGfCfccugCfcAfcc csusu |
| 458 | 1705 | gsusggCfaGfGfGfcgcccgcgca | 2311 | usGfscgcGfgGfCfgcccUfgCfca csusu |
| 480 | 1706 | asgsgcGfgCfCfUfgugcagcgca | 2312 | usGfscgcUfgCfAfcaggCfcGfcc ususu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 481 | 1707 | gsgscgGfcCfUfGfugcagcgcga | 2313 | usCfsgcgCfuGfCfacagGfcCfgccsusu |
| 482 | 1708 | gscsggCfcUfGfUfgcagcgcgga | 2314 | usCfscgcGfcUfGfcacaGfgCfcgcsusu |
| 534 | 1709 | csgsccUfuCfGfCfccacaccgga | 2315 | usCfscggUfgUfGfggcgAfaGfgcgsusu |
| 546 | 1710 | csasccGfgCfGfCfguggggaaca | 2316 | usGfsuucCfcCfAfcgcgCfcGfgugsusu |
| 547 | 1711 | ascscgGfcGfCfGfuggggaacga | 2317 | usCfsguuCfcCfCfacgcGfcCfggususu |
| 548 | 1712 | cscsggCfgCfGfUfggggaacgga | 2318 | usCfscguUfcCfCfcacgCfgCfcggsusu |
| 549 | 1713 | csgsgcGfcGfUfGfgggaacggga | 2319 | usCfsccgUfuCfCfccacGfcGfccgsusu |
| 551 | 1714 | gscsgcGfuGfGfGfgaacggggca | 2320 | usGfscccCfgUfUfccccAfcGfcgcsusu |
| 565 | 1715 | gsgsgcUfuCfCfCfgcaccccaca | 2321 | usGfsuggGfgUfGfcgggAfaGfcccsusu |
| 575 | 1716 | csasccCfcAfCfGfugcccugcga | 2322 | usCfsgcaGfgGfCfacguGfgGfgugsusu |
| 577 | 1717 | cscsccAfcGfUfGfcccugcgcga | 2323 | usCfsgcgCfaGfGfgcacGfuGfgggsusu |
| 579 | 1718 | cscsacGfuGfCfCfcugcgcgcca | 2324 | usGfsgcgCfgCfAfgggcAfcGfuggsusu |
| 581 | 1719 | ascsguGfcCfCfUfgcgcgccuga | 2325 | usCfsaggCfgCfGfcaggGfcAfcgususu |
| 588 | 1720 | csusgcGfcGfCfCfuggggcucua | 2326 | usAfsgagCfcCfCfaggcGfcGfcagsusu |
| 616 | 1721 | gscsuuUfcGfUfGfagccaggcaa | 2327 | usUfsgccUfgGfCfucacGfaAfagcsusu |
| 617 | 1722 | csusuuCfgUfGfAfgccaggcaga | 2328 | usCfsugcCfuGfGfcucaCfgAfaagsusu |
| 618 | 1723 | ususucGfuGfAfGfccaggcagca | 2329 | usGfscugCfcUfGfgcucAfcGfaaasusu |
| 627 | 1724 | cscsagGfcAfGfCfgagggccgca | 2330 | usGfscggCfcCfUfcgcuGfcCfuggsusu |
| 652 | 1725 | csusgcAfgCfCfCfagccaggcca | 2331 | usGfsgccUfgGfCfugggCfuGfcagsusu |
| 654 | 1726 | gscsagCfcCfAfGfccaggccgca | 2332 | usGfscggCfcUfGfgcugGfgCfugcsusu |
| 659 | 1727 | cscsagCfcAfGfGfccgcgccgga | 2333 | usCfscggCfgCfGfgccuGfgCfuggsusu |
| 668 | 1728 | cscsgcGfcCfGfGfcagaggggaa | 2334 | usUfsccccCfuCfUfgccgGfcGfcggsusu |
| 690 | 1729 | cscsaaCfcUfGfCfcccggcgcga | 2335 | usCfsgcgCfcGfGfggcaGfgUfuggsusu |
| 692 | 1730 | asasccUfgCfCfCfcggcgcgcga | 2336 | usCfsgcgCfgCfCfggggCfaGfguususu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 705 | 1731 | gscsgcGfgGfGfAfuuucgccuaa | 2337 | usUfsaggCfgAfAfauccCfcGfcg csusu |
| 715 | 1732 | ususcgCfcUfAfCfgccgccccga | 2338 | usCfsgggGfcGfGfcguaGfgCfga asusu |
| 717 | 1733 | csgsccUfaCfGfCfcgccccggca | 2339 | usGfsccgGfgGfCfggcgUfaGfgc gsusu |
| 732 | 1734 | gsgscuCfcUfCfCfggacggggca | 2340 | usGfscccCfgUfCfcggaGfgAfgc csusu |
| 733 | 1735 | gscsucCfuCfCfGfgacggggcga | 2341 | usCfsgccCfcGfUfccggAfgGfag csusu |
| 745 | 1736 | gsgsggCfgCfUfCfucccacccua | 2342 | usAfsgggUfgGfGfagagCfgCfcc csusu |
| 802 | 1737 | gsasggAfcCfGfGfgacccgcaga | 2343 | usCfsugcGfgGfUfcccgGfuCfcu csusu |
| 809 | 1738 | gsgsgaCfcCfGfCfagcgcgacga | 2344 | usCfsgucGfcGfCfugcgGfgUfcc csusu |
| 813 | 1739 | cscscgCfaGfCfGfcgacggccua | 2345 | usAfsggcCfgUfCfgcgcUfgCfgg gsusu |
| 827 | 1740 | gscscuGfcCfGfGfgccccugcga | 2346 | usCfsgcaGfgGfGfcccgGfcAfgg csusu |
| 839 | 1741 | cscsugCfgCfGfGfuggcacagca | 2347 | usGfscugUfgCfCfaccgCfgCfag gsusu |
| 842 | 1742 | gscsgcGfgUfGfGfcacagccuga | 2348 | usCfsaggCfuGfUfgccaCfcGfcg csusu |
| 843 | 1743 | csgscgGfuGfGfCfacagccugga | 2349 | usCfscagGfcUfGfugccAfcCfgc gsusu |
| 845 | 1744 | csgsguGfgCfAfCfagccugggca | 2350 | usGfscccAfgGfCfugugCfcAfcc gsusu |
| 850 | 1745 | gscsacAfgCfCfUfgggcccgcua | 2351 | usAfsgcgGfgCfCfcaggCfuGfug csusu |
| 856 | 1746 | cscsugGfgCfCfCfgcucaagcga | 2352 | usCfsgcuUfgAfGfcgggCfcCfag gsusu |
| 877 | 1747 | cscsgcAfgGfGfCfcaaggggua | 2353 | usCfsaccCfcUfUfggccCfuGfcg gsusu |
| 892 | 1748 | gsusgcUfuGfCfGfccacccacga | 2354 | usCfsgugGfgUfGfgcgcAfaGfca csusu |
| 893 | 1749 | usgscuUfgCfGfCfcacccacgua | 2355 | usAfscguGfgGfUfggcgCfaAfgc asusu |
| 894 | 1750 | gscsuuGfcGfCfCfacccacguca | 2356 | usGfsacgUfgGfGfuggcGfcAfag csusu |
| 895 | 1751 | csusugCfgCfCfAfcccacgucca | 2357 | usGfsgacGfuGfGfguggCfgCfaa gsusu |
| 897 | 1752 | usgscgCfcAfCfCfcacgucccaa | 2358 | usUfsgggAfcGfUfggguGfgCfgc asusu |
| 919 | 1753 | asgsucCfgUfGfGfuggggcugga | 2359 | usCfscagCfcCfCfaccaCfgGfac ususu |
| 936 | 1754 | gsgsgcCfgGfGfGfuccccaggua | 2360 | usAfsccuGfgGfGfacccCfgGfcc csusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 939 | 1755 | cscsggGfgUfCfCfccaggucgca | 2361 | usGfscgaCfcUfGfgggaCfcCfcg gsusu |
| 956 | 1756 | cscsggGfgCfGfGfcgugggaaca | 2362 | usGfsuucCfcAfCfgccgCfcCfcg gsusu |
| 989 | 1757 | csusccAfcCfUfCfcccagcccga | 2363 | usCfsgggCfuGfGfggagGfuGfga gsusu |
| 992 | 1758 | csasccUfcCfCfCfagcccgcgca | 2364 | usGfscgcGfgGfCfugggGfaGfgu gsusu |
| 994 | 1759 | cscsucCfcCfAfGfcccgcgccca | 2365 | usGfsggcGfcGfGfgcugGfgGfag gsusu |
| 1023 | 1760 | csgsccUfcCfGfCfgcggcaggga | 2366 | usCfsccuGfcCfGfcgcgGfaGfgc gsusu |
| 1028 | 1761 | cscsgcGfcGfGfCfaggggcagaa | 2367 | usUfscugCfcCfCfugccGfcGfcg gsusu |
| 1030 | 1762 | gscsgcGfgCfAfGfgggcagauga | 2368 | usCfsaucUfgCfCfccugCfcGfcg csusu |
| 1067 | 1763 | cscscaGfgCfGfCfuccaggagca | 2369 | usGfscucCfuGfGfagcgCfcUfgg gsusu |
| 1081 | 1764 | gsasgcCfgGfCfGfcccuggucua | 2370 | usAfsgacCfaGfGfgcgcCfgGfcu csusu |
| 1083 | 1765 | gscscgGfcGfCfCfcuggucugca | 2371 | usGfscagAfcCfAfgggcGfcCfgg csusu |
| 1084 | 1766 | cscsggCfgCfCfCfuggucugcaa | 2372 | usUfsgcaGfaCfCfagggCfgCfcg gsusu |
| 1085 | 1767 | csgsgcGfcCfCfUfggucugcaca | 2373 | usGfsugcAfgAfCfcaggGfcGfcc gsusu |
| 1102 | 1768 | csusccCfcUfGfCfggccugcuga | 2374 | usCfsagcAfgGfCfcgcaGfgGfga gsusu |
| 1120 | 1769 | csusggAfuGfAfGfcuccuggcga | 2375 | usCfsgccAfgGfAfgcucAfuCfca gsusu |
| 1189 | 1770 | gsgsggAfgCfUfGfgaggccucga | 2376 | usCfsgagGfcCfUfccagCfuCfcc csusu |
| 1192 | 1771 | gsasgcUfgGfAfGfgccucggaaa | 2377 | usUfsuccGfaGfGfccucCfaGfcu csusu |
| 1193 | 1772 | asgscuGfgAfGfGfccucggaaga | 2378 | usCfsuucCfgAfGfgccuCfcAfgc ususu |
| 1194 | 1773 | gscsugGfaGfGfCfcucggaagaa | 2379 | usUfscuuCfcGfAfggccUfcCfag csusu |
| 1212 | 1774 | gsgsccGfcCfUfCfgcuggaagca | 2380 | usGfscuuCfcAfGfcgagGfcGfgc csusu |
| 1213 | 1775 | gscscgCfcUfCfGfcuggaagcaa | 2381 | usUfsgcuUfcCfAfgcgaGfgCfgg csusu |
| 1214 | 1776 | cscsgcCfuCfGfCfuggaagcaca | 2382 | usGfsugcUfuCfCfagcgAfgGfcg gsusu |
| 1215 | 1777 | csgsccUfcGfCfUfggaagcacca | 2383 | usGfsgugCfuUfCfcagcGfaGfgc gsusu |
| 1216 | 1778 | gscscuCfgCfUfGfgaagcaccca | 2384 | usGfsgguGfcUfUfccagCfgAfgg csusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1218 | 1779 | csuscgCfuGfGfAfagcaccccua | 2385 | usAfsgggGfuGfCfuuccAfgCfga gsusu |
| 1234 | 1780 | csuscaGfcGfAfGfgaagaauaca | 2386 | usGfsuauUfcUfUfccucGfcUfga gsusu |
| 1235 | 1781 | uscsagCfgAfGfGfaagaauacca | 2387 | usGfsguaUfuCfUfuccuCfgCfug asusu |
| 1242 | 1782 | gsgsaaGfaAfUfAfccgggcucua | 2388 | usAfsgagCfcCfGfguauUfcUfuc csusu |
| 1251 | 1783 | cscsggGfcUfCfUfgcuggaggaa | 2389 | usUfsccuCfcAfGfcagaGfcCfcg gsusu |
| 1257 | 1784 | uscsugCfuGfGfAfggagcuuuaa | 2390 | usUfsaaaGfcUfCfcuccAfgCfag asusu |
| 1258 | 1785 | csusgcUfgGfAfGfgagcuuuaga | 2391 | usCfsuaaAfgCfUfccucCfaGfca gsusu |
| 1260 | 1786 | gscsugGfaGfGfAfgcuuuaggaa | 2392 | usUfsccuAfaAfGfcuccUfcCfag csusu |
| 1261 | 1787 | csusggAfgGfAfGfcuuuaggaca | 2393 | usGfsuccUfaAfAfgcucCfuCfca gsusu |
| 1265 | 1788 | asgsgaGfcUfUfUfaggacgcgga | 2394 | usCfscgcGfuCfCfuaaaGfcUfcc ususu |
| 1266 | 1789 | gsgsagCfuUfUfAfggacgcggga | 2395 | usCfsccgCfgUfCfcuaaAfgCfuc csusu |
| 1267 | 1790 | gsasgcUfuUfAfGfgacgcgggga | 2396 | usCfscccGfcGfUfccuaAfaGfcu csusu |
| 1268 | 1791 | asgscuUfuAfGfGfacgcggggua | 2397 | usAfscccCfgCfGfuccuAfaAfgc ususu |
| 1269 | 1792 | gscsuuUfaGfGfAfcgcgggguua | 2398 | usAfsaccCfcGfCfguccUfaAfag csusu |
| 1270 | 1793 | csusuuAfgGfAfCfgcgggguuga | 2399 | usCfsaacCfcCfGfcgucCfuAfaa gsusu |
| 1271 | 1794 | ususuaGfgAfCfGfcgggguugga | 2400 | usCfscaaCfcCfCfgcguCfcUfaa asusu |
| 1272 | 1795 | ususagGfaCfGfCfgggguuggga | 2401 | usCfsccaAfcCfCfcgcgUfcCfua asusu |
| 1274 | 1796 | asgsgaCfgCfGfGfgguugggaca | 2402 | usGfsuccCfaAfCfcccgCfgUfcc ususu |
| 1279 | 1797 | gscsggGfgUfUfGfggacggggua | 2403 | usAfscccCfgUfCfccaaCfcCfcg csusu |
| 1284 | 1798 | gsusugGfgAfCfGfgggucgggua | 2404 | usAfscccGfaCfCfccguCfcCfaa csusu |
| 1288 | 1799 | gsgsacGfgGfGfUfcggguguuua | 2405 | usAfsaccAfcCfCfgaccCfcGfuc csusu |
| 1389 | 1800 | gsgscuGfaCfCfGfgccugggaua | 2406 | usAfsuccCfaGfGfccggUfcAfgc csusu |
| 1390 | 1801 | gscsugAfcCfGfGfccugggauua | 2407 | usAfsaucCfcAfGfgccgGfuCfag csusu |
| 1400 | 1802 | csusggGfaUfUfCfcugccuucua | 2408 | usAfsgaaGfgCfAfggaaUfcCfca gsusu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1401 | 1803 | usgsggAfuUfCfCfugccuucuaa | 2409 | usUfsagaAfgGfCfaggaAfuCfcc asusu |
| 1419 | 1804 | gsgsucUfaGfGfCfccggugagaa | 2410 | usUfscucAfcCfGfggccUfaGfac csusu |
| 1420 | 1805 | gsuscuAfgGfCfCfcggugagaga | 2411 | usCfsucuCfaCfCfgggcCfuAfga csusu |
| 1421 | 1806 | uscsuaGfgCfCfCfggugagagaa | 2412 | usUfscucUfcAfCfcgggCfcUfag asusu |
| 1422 | 1807 | csusagGfcCfCfGfgugagagaca | 2413 | usGfsucuCfuCfAfccggGfcCfua gsusu |
| 1425 | 1808 | gsgsccCfgGfUfGfagagacucca | 2414 | usGfsgagUfcUfCfucacCfgGfgc csusu |
| 1426 | 1809 | gscsccGfgUfGfAfgagacuccaa | 2415 | usUfsggaGfuCfUfcucaCfcGfgg csusu |
| 1427 | 1810 | cscscgGfuGfAfGfagacuccaca | 2416 | usGfsuggAfgUfCfucucAfcCfgg gsusu |
| 1607 | 1811 | cscsccAfcCfUfUfccgacgcuga | 2417 | usCfsagcGfuCfGfgaagGfuGfgg gsusu |
| 1608 | 1812 | cscscaCfcUfUfCfcgacgcugua | 2418 | usAfscagCfgUfCfggaaGfgUfgg gsusu |
| 1612 | 1813 | cscsuuCfcGfAfCfgcugucuaga | 2419 | usCfsuagAfcAfGfcgucGfgAfag gsusu |
| 1613 | 1814 | csusucCfgAfCfGfcugucuagga | 2420 | usCfscuaGfaCfAfgcguCfgGfaa gsusu |
| 1614 | 1815 | ususccGfaCfGfCfugucuaggca | 2421 | usGfsccuAfgAfCfagcgUfcGfga asusu |
| 1615 | 1816 | uscscgAfcGfCfUfgucuaggcaa | 2422 | usUfsgccUfaGfAfcagcGfuCfgg asusu |
| 1616 | 1817 | cscsgaCfgCfUfGfucuaggcaaa | 2423 | usUfsugcCfuAfGfacagCfgUfcg gsusu |
| 1617 | 1818 | csgsacGfcUfGfUfcuaggcaaaa | 2424 | usUfsuugCfcUfAfgacaGfcGfuc gsusu |
| 420 | 2426 | csusGfguuUfCfAfgaAfucgaAf sgsa | 2437 | vpUsCfsuucgauucugaAfaccags usu |
| 1628 | 2427 | asgsGfcaaAfCfCfugGfauuaGf sasa | 2438 | vpUsUfscuaauccagguUfugccus usu |
| 1629 | 2428 | gsgsCfaaaCfCfUfggAfuuagAf sgsa | 2439 | vpUsCfsucuaauccaggUfuugccs usu |
| 1635 | 2429 | cscsUfggaUfUfAfgaGfuuacAf susa | 2440 | vpUsAfsuguaacucuaaUfccaggs usu |
| 1636 | 2430 | csusGfgauUfAfGfagUfuacaUf scsa | 2441 | vpUsGfsauguaacucuaAfuccags usu |
| 1652 | 2431 | uscsUfccuGfGfAfugAfuuagUf susa | 2442 | vpUsAfsacuaaucauccAfggagas usu |
| 1653 | 2432 | csusCfcugGfAfUfgaUfuaguUf scsa | 2443 | vpUsGfsaacuaaucaucCfaggags usu |
| 668 | 2433 | cscsGfcgcCfGfGfcaGfagggGf sasa | 2444 | vpUsUfsccccucugccgGfcgcggs usu |

TABLE 1B-continued provides modified siRNAs comprising modified sense strand and modified antisense strand.

| Position in transcript NM_001306068.3 | SEQ ID NO: | Sense strand | SEQ ID NO: | Antisense strand |
|---|---|---|---|---|
| 1654 | 2434 | uscsCfuggAfUfGfauUfaguuCfaa | 2445 | vpUsUfsgaacuaaucauCfcaggasusu |
| 1655 | 2435 | cscsUfggaUfGfAfuuAfguucAfga | 2446 | vpUsCfsugaacuaaucaUfccaggsusu |
| 1656 | 2436 | csusGfgauGfAfUfuaGfuucaGfaa | 2447 | vpUsUfscugaacuaaucAfuccagsusu |

Column 1 shows the beginning position of the target sequence in DUX4_human_#NM_001306068.3 (SEQ ID NO: 2425).
The target sequence is 19 nucleotide long starting from the beginning position.
For example, row 1 shows that the beginning position of the target sequence is 1, which means that the target sequence is the sequence corresponding to positions 1-19 of DUX4_human_#NM_001306068.3 (SEQ ID NO: 2425).
The sequences of the sense strands and antisense strands are shown from the 5' end to the 3' end.

TABLE 1C provides mRNA activity of exemplary siRNAs comprising modified sense strand and modified antisense strand.

| Position in transcript | SEQ ID NO: | Sense strand | SEQ ID NO: | Antisense strand | mRNA level, % at 10 nM |
|---|---|---|---|---|---|
| 11 | 1215 | csgsacAfcCfCfUfcggacagcaa | 1821 | usUfsgcuGfuCfCfgaggGfuGfucgsusu | 69.3 ± 4.6 |
| 13 | 1217 | ascsacCfcUfCfGfgacagcacca | 1823 | usGfsgugCfuGfUfccgaGfgGfugususu | 83.6 ± 4.4 |
| 61 | 1240 | csgsacGfgAfGfAfcucguuugga | 1846 | usCfscaaAfcGfAfgucuCfcGfucgsusu | 86.4 ± 6.3 |
| 67 | 1246 | asgsacUfcGfUfUfuggaccccga | 1852 | usCfsgggGfuCfCfaaacGfaGfucususu | 94.1 ± 6.2 |
| 109 | 1264 | usgscuUfuGfAfGfcggaacccga | 1870 | usCfsgggUfuCfCfgcucAfaAfgcasusu | 110.3 ± 5.2 |
| 115 | 1270 | gsasgcGfgAfAfCfccguacccga | 1876 | usCfsgggUfaCfGfgguuCfcGfcucsusu | 117.3 ± 15.1 |
| 124 | 1272 | cscsguAfcCfCfGfggcaucgcca | 1878 | usGfsgcgAfuGfCfccggGfuAfcggsusu | 76.3 ± 4.6 |
| 125 | 1273 | csgsuaCfcCfGfGfgcaucgccaa | 1879 | usUfsggcGfaUfGfcccgGfgUfacgsusu | 110.6 ± 6.5 |
| 131 | 1278 | csgsggCfaUfCfGfccaccagaga | 1884 | usCfsucuGfgUfGfgcgaUfgCfccgsusu | 80.8 ± 1.4 |
| 133 | 1280 | gsgscaUfcGfCfCfaccagagaaa | 1886 | usUfsucuCfuGfGfuggcGfaUfgccsusu | 80.5 ± 4 |
| 163 | 1297 | gscscaUfcGfGfCfauuccggaga | 1903 | usCfsuccGfgAfAfugccGfaUfggcsusu | 88.3 ± 7.2 |
| 164 | 1298 | cscsauCfgGfCfAfuuccggagca | 1904 | usGfscucCfgGfAfaugcCfgAfuggsusu | 88.5 ± 6.5 |
| 165 | 1299 | csasucGfgCfAfUfuccggagcca | 1905 | usGfsgcuCfcGfGfaaugCfcGfaugsusu | 90.4 ± 7.7 |
| 187 | 1313 | gsusccAfgAfUfUfugguuucaga | 1919 | usCfsugaAfaCfCfaaauCfuGfgacsusu | 60.3 ± 3.3 |
| 188 | 1314 | uscscaGfaUfUfUfgguuucagaa | 1920 | usUfscugAfaAfCfcaaaUfcUfggasusu | 73.4 ± 3.6 |
| 203 | 1327 | asgsaaUfgAfGfAfggucacgcca | 1933 | usGfsgcgUfgAfCfcucuCfaUfucususu | 127.4 ± 3.8 |

TABLE 1C-continued provides mRNA activity of exemplary siRNAs comprising modified sense strand and modified antisense strand.

| Position in transcript | SEQ ID NO: | Sense strand | SEQ ID NO: | Antisense strand | mRNA level, % at 10 nM |
|---|---|---|---|---|---|
| 204 | 1328 | gsasauGfaGfAfGfgucacgccaa | 1934 | usUfsggcGfuGfAfccucUfcAfuucsusu | 123.9 ± 10.8 |
| 277 | 1362 | gsasagGfcCfGfGfcgaaagcgga | 1968 | usCfscgcUfuUfCfgccgGfcCfuucsusu | 116.9 ± 9.2 |
| 292 | 1369 | csgsgaCfcGfCfCfgucaccggaa | 1975 | usUfsccgGfuGfAfcggcGfgUfccgsusu | 79.9 ± 36.3 |
| 299 | 1376 | cscsguCfaCfCfGfgaucccagaa | 1982 | usUfscugGfgAfUfccggUfgAfcggsusu | 118.8 ± 4.7 |
| 300 | 1377 | csgsucAfcCfGfGfaucccagaca | 1983 | usGfsucuGfgGfAfuccgGfuGfacgsusu | 108.1 ± 8.1 |
| 301 | 1378 | gsuscaCfcGfGfAfuccca gacca | 1984 | usGfsgucUfgGfGfauccGfgUfgacsusu | 81.3 ± 13.7 |
| 307 | 1384 | gsgsauCfcCfAfGfaccgcccuga | 1990 | usCfsaggGfcGfGfucugGfgAfuccsusu | 97.8 ± 13.6 |
| 315 | 1392 | gsasccGfcCfCfUfgcuccuccga | 1998 | usCfsggaGfgAfGfcaggGfcGfgucsusu | 108.8 ± 7.9 |
| 316 | 1393 | ascscgCfcCfUfGfcuccuccgaa | 1999 | usUfscggAfgGfAfgcagGfgCfggusus u | 104.7 ± 10 |
| 339 | 1399 | usgsagAfaGfGfAfucgcuuucca | 2005 | usGfsgaaAfgCfGfauccUfuCfucasusu | 60.6 ± 0.7 |
| 347 | 1407 | asuscgCfuUfUfCfcaggcaucga | 2013 | usCfsgauGfcCfUfggaaAfgCfgausus u | 103.4 ± 5.1 |
| 348 | 1408 | uscsgcUfuUfCfCfaggcaucgca | 2014 | usGfscgaUfgCfCfuggaAfaGfcgasusu | 75.9 ± 1.9 |
| 349 | 1409 | csgscuUfuCfCfAfggcaucgcca | 2015 | usGfsgcgAfuGfCfcuggAfaAfgcgsusu | 69.7 ± 7.3 |
| 404 | 1438 | asgsucCfaGfGfAfuucagaucua | 2044 | usAfsgauCfuGfAfauccUfgGfacusus u | 23.5 ± 7.3 |
| 412 | 1443 | asusucAfgAfUfCfugguuucaga | 2049 | usCfsugaAfaCfCfagauCfuGfaausus u | 22.1 ± 3.9 |
| 420 | 1444 | csusggUfuUfCfAfgaaucgaaga | 2050 | usCfsuucGfaUfUfcugaAfaCfcagsusu | 56.4 ± 10.9 |
| 532 | 1476 | gsuscgCfcUfUfCfgcccacacca | 2082 | usGfsgugUfgGfGfcgaaGfgCfgacsusu | 96.9 ± 3.5 |
| 533 | 1477 | uscsgcCfuUfCfGfcccacaccga | 2083 | usCfsgguGfuGfGfgcgaAfgGfcgasusu | 105 ± 4.7 |
| 619 | 1484 | ususcgUfgAfGfCfcaggcagcga | 2090 | usCfsgcuGfcCfUfggcuCfaCfgaasusu | 112.2 ± 3.4 |
| 620 | 1485 | uscsguGfaGfCfCfaggcagcgaa | 2091 | usUfscgcUfgCfCfuggcUfcAfcgasusu | 96 ± 2 |
| 621 | 1486 | csgsugAfgCfCfAfggcagcgaga | 2092 | usCfsucgCfuGfCfcuggCfuCfacgsusu | 94.4 ± 8.1 |
| 708 | 1499 | csgsggGfaUfUfUfcgccuacgca | 2105 | usGfscguAfgGfCfgaaaUfcCfccgsusu | 82.8 ± 5.8 |
| 747 | 1507 | gsgscgCfuCfUfCfccacccucaa | 2113 | usUfsgagGfgUfGfggagAfgCfgccsusu | 83.1 ± 6.3 |
| 748 | 1508 | gscsgcUfcUfCfCfcacccucaga | 2114 | usCfsugaGfgGfUfgggaGfaGfcgcsusu | 100.9 ± 5.5 |
| 749 | 1509 | csgscuCfuCfCfCfacccucagga | 2115 | usCfscugAfgGfGfugggAfgAfgcgsusu | 105.9 ± 9 |

TABLE 1C-continued provides mRNA activity of exemplary siRNAs comprising modified sense strand and modified antisense strand.

| Position in transcript | SEQ ID NO: | Sense strand | SEQ ID NO: | Antisense strand | mRNA level, % at 10 nM |
|---|---|---|---|---|---|
| 779 | 1526 | csusccGfcAfCfCfcgg gcaaaaa | 2132 | usUfsuuuGfcCfCfggguGfc Gfgagsusu | 147.2 ± 4.1 |
| 781 | 1528 | cscsgcAfcCfCfGfggc aaaagca | 2134 | usGfscuuUfuGfCfccggGfu Gfcggsusu | 103.5 ± 6.7 |
| 852 | 1537 | ascsagCfcUfGfGfgcc cgcucaa | 2143 | usUfsgagCfgGfGfcccaGfg Cfugusus u | 110.3 ± 6.8 |
| 1036 | 1561 | csasggGfgCfAfGfaug caaggca | 2167 | usGfsccuUfgCfAfucugCfc Cfcugsusu | 95 ± 4.8 |
| 1100 | 1580 | csascuCfcCfCfUfgcg gccugca | 2186 | usGfscagGfcCfGfcaggGfg Afgugsusu | 68.9 ± 6.8 |
| 1101 | 1581 | ascsucCfcCfUfGfcgg ccugcua | 2187 | usAfsgcaGfgCfCfgcagGfg Gfagusus u | 80.1 ± 7.3 |
| 1107 | 1584 | csusgcGfgCfCfUfgcu gcuggaa | 2190 | usUfsccaGfcAfGfcaggCfc Gfcagsusu | 90.5 ± 5.1 |
| 1109 | 1586 | gscsggCfcUfGfCfugc uggauga | 2192 | usCfsaucCfaGfCfagcaGfg Cfcgcsusu | 79.7 ± 11.1 |
| 1115 | 1592 | usgscuGfcUfGfGfaug agcucca | 2198 | usGfsgagCfuCfAfuccaGfc Afgcasusu | 84.7 ± 7.9 |
| 1131 | 1598 | cscsugGfcGfAfGfccc ggaguua | 2204 | usAfsacuCfcGfGfgcucGfc Cfaggsusu | 77.9 ± 9.6 |
| 1132 | 1599 | csusggCfgAfGfCfccg gaguuua | 2205 | usAfsaacUfcCfGfggcuCfg Cfcagsusu | 56.4 ± 1.7 |
| 1140 | 1603 | cscscgGfaGfUfUfucu gcagcaa | 2209 | usUfsgcuGfcAfGfaaacUfc Cfgggsusu | 116.1 ± 4.3 |
| 1141 | 1604 | cscsggAfgUfUfUfcug cagcaga | 2210 | usCfsugcUfgCfAfgaaaCfu Cfcggsusu | 94.4 ± 2.7 |
| 1147 | 1610 | ususucUfgCfAfGfcag gcgcaaa | 2216 | usUfsugcGfcCfUfgcugCfa Gfaaasusu | 73.3 ± 4.7 |
| 1148 | 1611 | ususcuGfcAfGfCfagg cgcaaca | 2217 | usGfsuugCfgCfCfugcuGfc Afgaasusu | 84 ± 0.8 |
| 1149 | 1612 | uscsugCfaGfCfAfggc gcaacca | 2218 | usGfsguuGfcGfCfcugcUfg Cfagasusu | 48.4 ± 4.3 |
| 1163 | 1626 | asasccUfcUfCfCfuag aaacgga | 2232 | usCfscguUfuCfUfaggaGfa Gfguusus u | 29 ± 4.5 |
| 1171 | 1629 | csusagAfaAfCfGfgag gccccga | 2235 | usCfsgggGfcCfUfccguUfu Cfuagsusu | 68.9 ± 3.7 |
| 1428 | 1630 | cscsggUfgAfGfAfgac uccacua | 2236 | usAfsgugGfaGfUfcucuCfa Cfcggsusu | 68.6 ± 2.6 |
| 1619 | 1645 | ascsgcUfgUfCfUfagg caaacca | 2251 | usGfsguuUfgCfCfuagaCfa Gfcgusus u | 27.8 ± 2.5 |
| 1628 | 1654 | asgsgcAfaAfCfCfugg auuagaa | 2260 | usUfscuaAfuCfCfagguUfu Gfccusus u | 18.1 ± 5.3 |
| 1629 | 1655 | gsgscaAfaCfCfUfgga uuagaga | 2261 | usCfsucuAfaUfCfcaggUfu Ufgccsusu | 18.1 ± 5.3 |
| 1635 | 1661 | cscsugGfaUfUfAfgag uuacaua | 2267 | usAfsuguAfaCfUfcuaaUfc Cfaggsusu | 11.5 ± 5.8 |
| 1636 | 1662 | csusggAfuUfAfGfagu uacauca | 2268 | usGfsaugUfaAfCfucuaAfu Cfcagsusu | 19.6 ± 3 |

TABLE 1C-continued provides mRNA activity of exemplary siRNAs comprising modified sense strand and modified antisense strand.

| Position in transcript | SEQ ID NO: | Sense strand | SEQ ID NO: | Antisense strand | mRNA level, % at 10 nM |
|---|---|---|---|---|---|
| 1637 | 1663 | usgsgaUfuAfGfAfguu acaucua | 2269 | usAfsgauGfuAfAfcucuAfa Ufccasusu | 34.8 ± 6.6 |
| 1638 | 1664 | gsgsauUfaGfAfGfuua caucuca | 2270 | usGfsagaUfgUfAfacucUfa Afuccsusu | 13.1 ± 1.7 |
| 1639 | 1665 | gsasuuAfgAfGfUfuac aucucca | 2271 | usGfsgagAfuGfUfaacuCfu Afaucsusu | 29.9 ± 6.2 |
| 1651 | 1670 | asuscuCfcUfGfGfaug auuagua | 2276 | usAfscuaAfuCfAfuccaGfg Afgausus u | 30.4 ± 7.4 |
| 1652 | 1671 | uscsucCfuGfGfAfuga uuaguua | 2277 | usAfsacuAfaUfCfauccAfg Gfagasusu | 10.1 ± 2.5 |
| 1653 | 1672 | csusccUfgGfAfUfgau uaguuca | 2278 | usGfsaacUfaAfUfcaucCfa Gfgagsusu | 24.1 ± 5.3 |
| 1654 | 1673 | uscscuGfgAfUfGfauu aguucaa | 2279 | usUfsgaaCfuAfAfucauCfc Afggasusu | 10.7 ± 1.3 |
| 1655 | 1674 | cscsugGfaUfGfAfuua guucaga | 2280 | usCfsugaAfcUfAfaucaUfc Cfaggsusu | 14 ± 14.6 |
| 1656 | 1675 | csusggAfuGfAfUfuag uucagaa | 2281 | usUfscugAfaCfUfaaucAfu Cfcagsusu | 3.2 ± 0.8 |
| 27 | 1677 | csasccCfuCfCfCfcgc ggaagca | 2283 | usGfscuuCfcGfCfggggAfg Gfgugsusu | 91.5 ± 1.7 |
| 28 | 1678 | ascsccUfcCfCfCfgcg gaagcca | 2284 | usGfsgcuUfcCfGfcgggGfa Gfggusus u | 85.6 ± 6.4 |
| 251 | 1686 | cscsugGfcCfCfGfgga gacgcga | 2292 | usCfsgcgUfcUfCfccggGfc Cfaggsusu | 125.4 ± 9.2 |
| 252 | 1687 | csusggCfcCfGfGfgag acgcgga | 2293 | usCfscgcGfuCfUfcccgGfg Cfcagsusu | 136.3 ± 23.7 |
| 317 | 1693 | cscsgcCfcUfGfCfucc uccgaga | 2299 | usCfsucgGfaGfGfagcaGfg Gfcggsusu | 80.4 ± 5.4 |
| 355 | 1694 | cscsagGfcAfUfCfgcc gcccgga | 2300 | usCfscggGfcGfGfcgauGfc Cfuggsusu | 106.5 ± 22.1 |
| 363 | 1699 | csgsccGfcCfCfGfgga ggagcua | 2305 | usAfsgcuCfcUfCfccggGfc Gfgcgsusu | 90.9 ± 5.5 |
| 437 | 1700 | gsgsgcCfaGfGfCfacc cgggaca | 2306 | usGfsuccCfgGfGfugccUfg Gfcccsusu | 151.6 ± 3.6 |
| 452 | 1701 | gsascaGfgGfUfGfgca gggcgca | 2307 | usGfscgcCfcUfGfccacCfc Ufgucsusu | 116.8 ± 6.3 |
| 453 | 1702 | ascsagGfgUfGfGfcag ggcgcca | 2308 | usGfsgcgCfcCfUfgccaCfc Cfugusus u | 111.9 ± 10.8 |
| 547 | 1711 | ascscgGfcGfCfGfugg ggaacga | 2317 | usCfsguuCfcCfCfacgcGfc Cfggusus u | 69.3 ± 9.9 |
| 548 | 1712 | cscsggCfgCfGfUfggg gaacgga | 2318 | usCfscguUfcCfCfcacgCfg Cfcggsusu | 109.4 ± 16 |
| 549 | 1713 | csgsgcGfcGfUfGfggg aacggga | 2319 | usCfsccgUfuCfCfccacGfc Gfccgsusu | 106.2 ± 17.4 |
| 565 | 1715 | gsgsgcUfuCfCfCfgca ccccaca | 2321 | usGfsuggGfgUfGfcgggAfa Gfcccsusu | 93.2 ± 12.1 |
| 579 | 1718 | cscsacGfuGfCfCfcug cgcgcca | 2324 | usGfsgcgCfgCfAfgggcAfc Gfuggsusu | 76.8 ± 14.7 |
| 581 | 1719 | ascsguGfcCfCfUfgcg cgccuga | 2325 | usCfsaggCfgCfGfcaggGfc Afcgusus u | 135.7 ± 4.9 |

TABLE 1C-continued provides mRNA activity of exemplary siRNAs comprising modified sense strand and modified antisense strand.

| Position in transcript | SEQ ID NO: | Sense strand | SEQ ID NO: | Antisense strand | mRNA level, % at 10 nM |
|---|---|---|---|---|---|
| 588 | 1720 | csusgcGfcGfCfCfugg ggcucua | 2326 | usAfsgagCfcCfCfaggcGfc Gfcagsusu | 153.3 ± 29.1 |
| 627 | 1724 | cscsagGfcAfGfCfgag ggccgca | 2330 | usGfscggCfcCfUfcgcuGfc Cfuggsusu | 134.6 ± 20.4 |
| 652 | 1725 | csusgcAfgCfCfCfagc caggcca | 2331 | usGfsgccUfgGfCfugggCfu Gfcagsusu | 134.7 ± 7.3 |
| 659 | 1727 | cscsagCfcAfGfGfccg cgccgga | 2333 | usCfscggCfgCfGfgccuGfg Cfuggsusu | 132.1 ± 10.9 |
| 668 | 1728 | cscsgcGfcCfGfGfcag aggggaa | 2334 | usUfscccCfuCfUfgccgGfc Gfcggsusu | 110.8 ± 2.7 |
| 692 | 1730 | asasccUfgCfCfCfcgg cgcgcga | 2336 | usCfsgcgCfgCfCfggggCfa Gfguusus u | 111.7 ± 11.1 |
| 715 | 1732 | ususcgCfcUfAfCfgcc gccccga | 2338 | usCfsgggGfcGfGfcguaGfg Cfgaasusu | 123.4 ± 14.3 |
| 717 | 1733 | csgsccUfaCfGfCfcgc cccggca | 2339 | usGfsccgGfgGfCfggcgUfa Gfgcgsusu | 146 ± 19.9 |
| 732 | 1734 | gsgscuCfcUfCfCfgga cggggca | 2340 | usGfsccccCfgUfCfcggaGfg Afgccsusu | 99.8 ± 10.3 |
| 733 | 1735 | gscsucCfuCfCfGfgac ggggcga | 2341 | usCfsgccCfcGfUfccggAfg Gfagcsusu | 115.5 ± 7.3 |
| 813 | 1739 | cscscgCfaGfCfGfcga cggccua | 2345 | usAfsggcCfgUfCfgcgcUfg Cfgggsusu | 87 ± 9.8 |
| 827 | 1740 | gscscuGfcCfGfGfgcc ccugcga | 2346 | usCfsgcaGfgGfGfcccgGfc Afggcsusu | 120.7 ± 4.5 |
| 843 | 1743 | csgscgGfuGfGfCfaca gccugga | 2349 | usCfscagGfcUfGfugccAfc Cfgcgsusu | 145.9 ± 57 |
| 845 | 1744 | csgsguGfgCfAfCfagc cugggca | 2350 | usGfscccAfgGfCfugugCfc Afccgsusu | 104.5 ± 6.2 |
| 877 | 1747 | cscsgcAfgGfGfCfcaa gggguga | 2353 | usCfsaccCfcUfUfggccCfu Gfcggsusu | 268.3 ± 2.3 |
| 892 | 1748 | gsusgcUfuGfCfGfcca cccacga | 2354 | usCfsgugGfgUfGfgcgcAfa Gfcacsusu | 184 ± 4.8 |
| 893 | 1749 | usgscuUfgCfGfCfcac ccacgua | 2355 | usAfscguGfgGfUfggcgCfa Afgcasusu | 207.9 ± 46.2 |
| 939 | 1755 | cscsggGfgUfCfCfcca ggucgca | 2361 | usGfscgaCfcUfGfgggaCfc Cfcggsusu | 134.4 ± 12.5 |
| 956 | 1756 | cscsggGfgCfGfGfcgu gggaaca | 2362 | usGfsuucCfcAfCfgccgCfc Cfcggsusu | 74.4 ± 22.1 |
| 989 | 1757 | csusccAfcCfUfCfccca gcccga | 2363 | usCfsgggCfuGfGfggagGfu Gfgagsusu | 164.5 ± 14.2 |
| 1028 | 1761 | cscsgcGfcGfGfCfagg ggcagaa | 2367 | usUfscugCfcCfCfugccGfc Gfcggsusu | 165.2 ± 13.4 |
| 1067 | 1763 | cscscaGfgCfGfCfucc aggagca | 2369 | usGfscucCfuGfGfagcgCfc Ufgggsusu | 86.3 ± 5.4 |
| 1083 | 1765 | gscscgGfcGfCfCfcug gucugca | 2371 | usGfscagAfcCfAfgggcGfc Cfggcsusu | 94.6 ± 5.2 |
| 1084 | 1766 | cscsggCfgCfCfCfugg ucugcaa | 2372 | usUfsgcaGfaCfCfagggCfg Cfcggsusu | 88.2 ± 40 |

TABLE 1C-continued provides mRNA activity of exemplary siRNAs comprising modified sense strand and modified antisense strand.

| Position in transcript | SEQ ID NO: | Sense strand | SEQ ID NO: | Antisense strand | mRNA level, % at 10 nM |
|---|---|---|---|---|---|
| 1085 | 1767 | csgsgcGfcCfCfUfggucugcaca | 2373 | usGfsugcAfgAfCfcaggGfcGfccgsusu | 409.8 ± 34.8 |
| 1212 | 1774 | gsgsccGfcCfUfCfgcuggaagca | 2380 | usGfscuuCfcAfGfcgagGfcGfgccsusu | 101.1 ± 14.1 |
| 1213 | 1775 | gscscgCfcUfCfGfcuggaagcaa | 2381 | usUfsgcuUfcCfAfgcgaGfgCfggcsusu | 25.1 ± 4.6 |
| 1235 | 1781 | uscsagCfgAfGfGfaagaauacca | 2387 | usGfsguaUfuCfUfuccuCfgCfugasusu | 43.5 ± 4.2 |
| 1251 | 1783 | cscsggGfcUfCfUfgcuggaggaa | 2389 | usUfsccuCfcAfGfcagaGfcCfcggsusu | 167.4 ± 7.4 |
| 1260 | 1786 | gscsugGfaGfGfAfgcuuuaggaa | 2392 | usUfsccuAfaAfGfcuccUfcCfagcsusu | 113.5 ± 2 |
| 1261 | 1787 | csusggAfgGfAfGfcuuuaggaca | 2393 | usGfsuccUfaAfAfgcucCfuCfcagsusu | 79.4 ± 7.7 |
| 1267 | 1790 | gsasgcUfuUfAfGfgacgcgggga | 2396 | usCfscccGfcGfUfccuaAfaGfcucsusu | 43.3 ± 2.9 |
| 1268 | 1791 | asgscuUfuAfGfGfacgcggggua | 2397 | usAfscccCfgCfGfuccuAfaAfgcusus u | 59.6 ± 10.2 |
| 1269 | 1792 | gscsuuUfaGfGfAfcgcgggguua | 2398 | usAfsaccCfcGfCfguccUfaAfagcsusu | 138 ± 17.3 |
| 1274 | 1796 | asgsgaCfgCfGfGfgguugggaca | 2402 | usGfsuccCfaAfCfcccgCfgUfccusus u | 142.5 ± 9.3 |
| 1279 | 1797 | gscsggGfgUfUfGfggacggggua | 2403 | usAfscccCfgUfCfccaaCfcCfcgcsusu | 122.7 ± 2.6 |
| 1284 | 1798 | gsusugGfgAfCfGfgggucgggua | 2404 | usAfscccGfaCfCfccguCfcCfaacsusu | 100.2 ± 9 |
| 1288 | 1799 | gsgsacGfgGfGfUfcgggugguua | 2405 | usAfsaccAfcCfCfgaccCfcGfuccsusu | 58.3 ± 6.7 |
| 1389 | 1800 | gsgscuGfaCfCfGfgccugggaua | 2406 | usAfsuccCfaGfGfccggUfcAfgccsusu | 203.5 ± 86.3 |
| 1390 | 1801 | gscsugAfcCfGfGfccugggauua | 2407 | usAfsaucCfcAfGfgccgGfuCfagcsusu | 477.1 ± 98.6 |
| 1421 | 1806 | uscsuaGfgCfCfCfggugagagaa | 2412 | usUfscucUfcAfCfcgggCfcUfagasusu | 182 ± 17.3 |
| 1427 | 1810 | cscscgGfuGfAfGfagacuccaca | 2416 | usGfsuggAfgUfCfucucAfcCfgggsusu | 79.2 ± 20 |
| 1612 | 1813 | cscsuuCfcGfAfCfgcugucuaga | 2419 | usCfsuagAfcAfGfcgucGfgAfaggsusu | 58.8 ± 7.7 |
| 1613 | 1814 | csusucCfgAfCfGfcugucuagga | 2420 | usCfscuaGfaCfAfgcguCfgGfaagsusu | 62.5 ± 5.9 |

Column 1 shows the beginning position of the target sequence in DUX4_human_#NM_001306068.3 (SEQ ID NO: 2425).

The target sequence is 19 nucleotide long starting from the beginning position.

For example, row 1 shows that the beginning position of the target sequence is 11, which means that the target sequence is the sequence corresponding to positions 11-29 of DUX4_human_#NM_001306068.3 (SEQ ID NO: 2425).

The sequences of the sense strands and antisense strands are shown from the 5' end to the 3' end.

TABLE 1D provides IC50 values of exemplary siRNAs comprising modified sense strand and modified antisense strand.

| Position in transcript | Corresponding Unmodified siRNAs SEQ ID NO of Sense strand | SEQ ID NO of Antisense strand | Modified siRNAs SEQ ID NO: | Sense strand | SEQ ID NO: | Antisense strand | IC50, pM |
|---|---|---|---|---|---|---|---|
| 61 | 28 | 634 | 1240 | csgsacGfgAfGfAfc ucguuugga | 1846 | usCfscaaAfcGfAfgucuC fcGfucgsusu | 817.2 ± 1425.6 |
| 404 | 226 | 832 | 1438 | asgsucCfaGfGfAfu ucagaucua | 2044 | usAfsgauCfuGfAfauccU fgGfacusus u | 71.4 ± 24 |
| 412 | 231 | 837 | 1443 | asusucAfgAfUfCfu gguuucaga | 2049 | usCfsugaAfaCfCfagau CfuGfaausus u | 84.1 ± 41.8 |
| 1163 | 414 | 1020 | 1626 | asasccUfcUfCfCfu agaaacgga | 2232 | usCfscguUfuCfUfagga GfaGfguusus u | 660.5 ± 269.1 |
| 1619 | 433 | 1039 | 1645 | ascsgcUfgUfCfUfa ggcaaacca | 2251 | usGfsguuUfgCfCfuaga CfaGfcgusus u | 91.7 ± 38.4 |
| 1628 | 442 | 1048 | 1654 | asgsgcAfaAfCfCfu ggauuagaa | 2260 | usUfscuaAfuCfCfaggu UfuGfccusus u | 30.5 ± 13.3 |
| 1629 | 443 | 1049 | 1655 | gsgscaAfaCfCfUfg gauuagaga | 2261 | usCfsucuAfaUfCfcaggU fuUfgccsusu | 89.8 ± 44.4 |
| 1635 | 449 | 1055 | 1661 | cscsugGfaUfUfAfg aguuacaua | 2267 | usAfsuguAfaCfUfcuaaU fcCfaggsusu | 23.6 ± 12.2 |
| 1636 | 450 | 1056 | 1662 | csusggAfuUfAfGfa guuacauca | 2268 | usGfsaugUfaAfCfucua AfuCfcagsusu | 94.3 ± 29.2 |
| 1651 | 458 | 1064 | 1670 | asuscuCfcUfGfGfa ugauuagua | 2276 | usAfscuaAfuCfAfuccaG fgAfgausus u | 26.8 ± 29.1 |
| 1652 | 459 | 1065 | 1671 | uscsucCfuGfGfAfu gauuaguua | 2277 | usAfsacuAfaUfCfauccA fgGfagasusu | 27.3 ± 11.7 |
| 1653 | 460 | 1066 | 1672 | csusccUfgGfAfUfg auuaguuca | 2278 | usGfsaacUfaAfUfcaucC faGfgagsusu | 105.4 ± 55.2 |
| 1654 | 461 | 1067 | 1673 | uscscuGfgAfUfGfa uuaguucaa | 2279 | usUfsgaaCfuAfAfucauC fcAfggasusu | 133.7 ± 57.8 |
| 1655 | 462 | 1068 | 1674 | cscsugGfaUfGfAfu uaguucaga | 2280 | usCfsugaAfcUfAfaucaU fcCfaggsusu | 32.6 ± 22.6 |
| 1656 | 463 | 1069 | 1675 | csusggAfuGfAfUfu aguucagaa | 2281 | usUfscugAfaCfUfaaucA fuCfcagsusu | 20.9 ± 14.1 |
| 1213 | 563 | 1169 | 1775 | gscscgCfcUfCfGfc uggaagcaa | 2381 | usUfsgcuUfcCfAfgcgaG fgCfggcsusu | 138.3 ± 71.8 |
| 1267 | 578 | 1184 | 1790 | gsasgcUfuUfAfGfg acgcgggga | 2396 | usCfscccGfcGfUfccuaA faGfcucsusu | 31.4 ± 45.4 |

Column 1 shows the beginning position of the target sequence in DUX4_human_#NM_001306068.3 (SEQ ID NO: 2425).
The target sequence is 19 nucleotide long starting from the beginning position.
For example, row 1 shows that the beginning position of the target sequence is 61, which means that the target sequence is the sequence corresponding to positions 61-79 of DUX4_human_#NM_001306068.3 (SEQ ID NO: 2425)

TABLE 1E provides comparison of mRNA knockdown activity of exemplary siRNAs comprising modified sense strand and modified antisense strand with different chemical modifications.

| | Corresponding Unmodified siRNAs | | Modified siRNAs | | | | | | |
|---|---|---|---|---|---|---|---|---|---|
| Position in transcript | SEQ ID NO of Sense strand | SEQ ID NO of Anti-sense strand | SEQ ID NO: | Sense strand | SEQ ID NO: | Antisense strand | mRNA level, % for 10 nM siRNA | mRNA level, % for 1 nM siRNA | mRNA level, % for 0.1 nM siRNA |
| 420 | 232 | 838 | 1444 | csusggUfuUfCfAfgaaucgaaga | 2050 | usCfsuucGfaUfUfcugaAfaCfcagsusu | 22 ± 2 | 65 ± 6 | 85 ± 12 |
| 420 | 232 | 838 | 2426 | csusGfguuUfCfAfgaAfucgaAfsgsa | 2437 | vpUsCfsuucgauucugaAfaccagsusu | 21 ± 6 | 56 ± 3 | 81 ± 22 |
| 1628 | 442 | 1048 | 1654 | asgsgcAfaAfCfCfuggauuagaa | 2260 | usUfscuaAfuCfCfagguUfuGfccusus u | 26 ± 4 | 45 ± 11 | 68 ± 3 |
| 1628 | 442 | 1048 | 2427 | asgsGfcaaAfCfCfugGfauuaGfsasa | 2438 | vpUsUfscuaauccagguUfugccusus u | 20 ± 4 | 35 ± 2 | 47 ± 5 |
| 1629 | 443 | 1049 | 1655 | gsgscaAfaCfCfUfggauuagaga | 2261 | usCfsucuAfaUfCfcaggUfuUfgccsusu | 28 ± 6 | 61 ± 12 | 92 ± 2 |
| 1629 | 443 | 1049 | 2428 | gsgsCfaaaCfCfUfggAfuuagAfsgsa | 2439 | vpUsCfsucuaauccaggUfuugccsusu | 31 ± 4 | 40 ± 4 | 67 ± 5 |
| 1635 | 449 | 1055 | 1661 | cscsugGfaUfUfAfgaguuacaua | 2267 | usAfsuguAfaCfUfcuaaUfcCfaggsusu | 18 ± 3 | 42 ± 4 | 61 ± 7 |
| 1635 | 449 | 1055 | 2429 | cscsUfggaUfUfAfgaGfuuacAfsusa | 2440 | vpUsAfsuguaacucuaaUfccaggsusu | 12 ± 2 | 28 ± 2 | 42 ± 10 |
| 1636 | 450 | 1056 | 1662 | csusggAfuUfAfGfaguuacauca | 2268 | usGfsaugUfaAfCfucuaAfuCfcagsusu | 19 ± 2 | 61 ± 7 | 84 ± 10 |
| 1636 | 450 | 1056 | 2430 | csusGfgauUfAfGfagUfuacaUfscsa | 2441 | vpUsGfsauguaacucuaAfuccagsusu | 28 ± 6 | 54 ± 12 | 84 ± 6 |
| 1652 | 459 | 1065 | 1671 | uscsucCfuGfGfAfugauuaguua | 2277 | usAfsacuAfaUfCfauccAfgGfagasusu | 20 ± 1 | 46 ± 7 | 65 ± 11 |
| 1652 | 459 | 1065 | 2431 | uscsUfccuGfGfAfugAfuuagUfsusa | 2442 | vpUsAfsacuaaucauccAfggagasusu | 17 ± 6 | 32 ± 5 | 48 ± 6 |
| 1653 | 460 | 1066 | 1672 | csusccUfgGfAfUfgauuaguuca | 2278 | usGfsaacUfaAfUfcaucCfaGfgagsusu | 37 ± 7 | 73 ± 12 | 91 ± 22 |
| 1653 | 460 | 1066 | 2432 | csusCfcugGfAfUfgaUfuaguUfscsa | 2443 | vpUsGfsaacuaaucauCcfaggagsusu | 47 ± 11 | 69 ± 11 | 81 ± 9 |
| 668 | 516 | 1122 | 1728 | cscsgcGfcCfGfGfcagaggggaa | 2334 | usUfscccCfuCfUfgccgGfcGfcggsusu | 91 ± 12 | 93 ± 25 | 99 ± 11 |
| 668 | 516 | 1122 | 2433 | cscsGfcgcCfGfGfcaGfagggGfsasa | 2444 | vpUsUfsccccucugccgGfcgcggsusu | 108 ± 8 | 111 ± 24 | 99 ± 12 |

Column 1 shows the beginning position of the target sequence in DUX4_human_#NM_001306068.3 (SEQ ID NO: 2425).

The target sequence is 19 nucleotide long starting from the beginning position.

For example, row 1 shows that the beginning position of the target sequence is 420, which means that the target sequence is the sequence corresponding to positions 420-438 of DUX4_human_#NM_001306068.3 (SEQ ID NO: 2425).

The sequences of the sense strands and antisense strands are shown from the 5' end to the 3' end.

TABLE 1F provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 1 | 2448 | AUGGCCCUCCCGACACCCU | 3012 | AGGGUGUCGGGAGGGCCAU |
| 2 | 2449 | UGGCCCUCCCGACACCCUC | 3013 | GAGGGUGUCGGGAGGGCCA |
| 11 | 2450 | CGACACCCUCGGACAGCAC | 3014 | GUGCUGUCCGAGGGUGUCG |
| 12 | 2451 | GACACCCUCGGACAGCACC | 3015 | GGUGCUGUCCGAGGGUGUC |
| 13 | 2452 | ACACCCUCGGACAGCACCC | 3016 | GGGUGCUGUCCGAGGGUGU |
| 14 | 2453 | CACCCUCGGACAGCACCCU | 3017 | AGGGUGCUGUCCGAGGGUG |
| 15 | 2454 | ACCCUCGGACAGCACCCUC | 3018 | GAGGGUGCUGUCCGAGGGU |
| 16 | 2455 | CCCUCGGACAGCACCCUCC | 3019 | GGAGGGUGCUGUCCGAGGG |
| 17 | 2456 | CCUCGGACAGCACCCUCCC | 3020 | GGGAGGGUGCUGUCCGAGG |
| 18 | 2457 | CUCGGACAGCACCCUCCCC | 3021 | GGGGAGGGUGCUGUCCGAG |
| 19 | 2458 | UCGGACAGCACCCUCCCCG | 3022 | CGGGGAGGGUGCUGUCCGA |
| 23 | 2459 | ACAGCACCCUCCCCGCGGA | 3023 | UCCGCGGGGAGGGUGCUGU |
| 24 | 2460 | CAGCACCCUCCCCGCGGAA | 3024 | UUCCGCGGGGAGGGUGCUG |
| 25 | 2461 | AGCACCCUCCCCGCGGAAG | 3025 | CUUCCGCGGGGAGGGUGCU |
| 39 | 15 | GGAAGCCCGGGGACGAGGA | 3026 | UCCUCGUCCCCGGGCUUCC |
| 40 | 16 | GAAGCCCGGGGACGAGGAC | 3027 | GUCCUCGUCCCCGGGCUUC |
| 41 | 17 | AAGCCCGGGGACGAGGACG | 3028 | CGUCCUCGUCCCCGGGCUU |
| 49 | 18 | GGACGAGGACGGCGACGGA | 3029 | UCCGUCGCCGUCCUCGUCC |
| 50 | 19 | GACGAGGACGGCGACGGAG | 3030 | CUCCGUCGCCGUCCUCGUC |
| 51 | 20 | ACGAGGACGGCGACGGAGA | 3031 | UCUCCGUCGCCGUCCUCGU |
| 52 | 21 | CGAGGACGGCGACGGAGAC | 3032 | GUCUCCGUCGCCGUCCUCG |
| 53 | 2462 | GAGGACGGCGACGGAGACU | 3033 | AGUCUCCGUCGCCGUCCUC |
| 54 | 2463 | AGGACGGCGACGGAGACUC | 3034 | GAGUCUCCGUCGCCGUCCU |
| 55 | 2464 | GGACGGCGACGGAGACUCG | 3035 | CGAGUCUCCGUCGCCGUCC |
| 56 | 2465 | GACGGCGACGGAGACUCGU | 3036 | ACGAGUCUCCGUCGCCGUC |
| 57 | 2466 | ACGGCGACGGAGACUCGUU | 3037 | AACGAGUCUCCGUCGCCGU |
| 60 | 2467 | GCGACGGAGACUCGUUUGG | 3038 | CCAAACGAGUCUCCGUCGC |
| 61 | 2468 | CGACGGAGACUCGUUUGGA | 3039 | UCCAAACGAGUCUCCGUCG |
| 62 | 2469 | GACGGAGACUCGUUUGGAC | 3040 | GUCCAAACGAGUCUCCGUC |
| 63 | 2470 | ACGGAGACUCGUUUGGACC | 3041 | GGUCCAAACGAGUCUCCGU |
| 64 | 2471 | CGGAGACUCGUUUGGACCC | 3042 | GGGUCCAAACGAGUCUCCG |
| 65 | 2472 | GGAGACUCGUUUGGACCCC | 3043 | GGGGUCCAAACGAGUCUCC |
| 66 | 2473 | GAGACUCGUUUGGACCCCG | 3044 | CGGGGUCCAAACGAGUCUC |
| 67 | 2474 | AGACUCGUUUGGACCCCGA | 3045 | UCGGGGUCCAAACGAGUCU |
| 71 | 2475 | UCGUUUGGACCCCGAGCCA | 3046 | UGGCUCGGGGUCCAAACGA |
| 76 | 2476 | UGGACCCCGAGCCAAAGCG | 3047 | CGCUUUGGCUCGGGGUCCA |
| 77 | 37 | GGACCCCGAGCCAAAGCGA | 3048 | UCGCUUUGGCUCGGGGUCC |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 78 | 38 | GACCCCGAGCCAAAGCGAG | 3049 | CUCGCUUUGGCUCGGGGUC |
| 79 | 39 | ACCCCGAGCCAAAGCGAGG | 3050 | CCUCGCUUUGGCUCGGGGU |
| 80 | 40 | CCCCGAGCCAAAGCGAGGC | 3051 | GCCUCGCUUUGGCUCGGGG |
| 81 | 41 | CCCGAGCCAAAGCGAGGCC | 3052 | GGCCUCGCUUUGGCUCGGG |
| 82 | 42 | CCGAGCCAAAGCGAGGCCC | 3053 | GGGCCUCGCUUUGGCUCGG |
| 83 | 2477 | CGAGCCAAAGCGAGGCCCU | 3054 | AGGGCCUCGCUUUGGCUCG |
| 84 | 2478 | GAGCCAAAGCGAGGCCCUG | 3055 | CAGGGCCUCGCUUUGGCUC |
| 85 | 2479 | AGCCAAAGCGAGGCCCUGC | 3056 | GCAGGGCCUCGCUUUGGCU |
| 86 | 2480 | GCCAAAGCGAGGCCCUGCG | 3057 | CGCAGGGCCUCGCUUUGGC |
| 87 | 2481 | CCAAAGCGAGGCCCUGCGA | 3058 | UCGCAGGGCCUCGCUUUGG |
| 88 | 2482 | CAAAGCGAGGCCCUGCGAG | 3059 | CUCGCAGGGCCUCGCUUUG |
| 89 | 2483 | AAAGCGAGGCCCUGCGAGC | 3060 | GCUCGCAGGGCCUCGCUUU |
| 90 | 2484 | AAGCGAGGCCCUGCGAGCC | 3061 | GGCUCGCAGGGCCUCGCUU |
| 108 | 2485 | CUGCUUUGAGCGGAACCCG | 3062 | CGGGUUCCGCUCAAAGCAG |
| 109 | 2486 | UGCUUUGAGCGGAACCCGU | 3063 | ACGGGUUCCGCUCAAAGCA |
| 110 | 2487 | GCUUUGAGCGGAACCCGUA | 3064 | UACGGGUUCCGCUCAAAGC |
| 111 | 2488 | CUUUGAGCGGAACCCGUAC | 3065 | GUACGGGUUCCGCUCAAAG |
| 112 | 2489 | UUUGAGCGGAACCCGUACC | 3066 | GGUACGGGUUCCGCUCAAA |
| 113 | 2490 | UUGAGCGGAACCCGUACCC | 3067 | GGGUACGGGUUCCGCUCAA |
| 114 | 2491 | UGAGCGGAACCCGUACCCG | 3068 | CGGGUACGGGUUCCGCUCA |
| 115 | 2492 | GAGCGGAACCCGUACCCGG | 3069 | CCGGGUACGGGUUCCGCUC |
| 116 | 2493 | AGCGGAACCCGUACCCGGG | 3070 | CCCGGGUACGGGUUCCGCU |
| 124 | 2494 | CCGUACCCGGGCAUCGCCA | 3071 | UGGCGAUGCCCGGGUACGG |
| 125 | 2495 | CGUACCCGGGCAUCGCCAC | 3072 | GUGGCGAUGCCCGGGUACG |
| 126 | 2496 | GUACCCGGGCAUCGCCACC | 3073 | GGUGGCGAUGCCCGGGUAC |
| 127 | 2497 | UACCCGGGCAUCGCCACCA | 3074 | UGGUGGCGAUGCCCGGGUA |
| 129 | 2498 | CCCGGGCAUCGCCACCAGA | 3075 | UCUGGUGGCGAUGCCCGGG |
| 130 | 2499 | CCGGGCAUCGCCACCAGAG | 3076 | CUCUGGUGGCGAUGCCCGG |
| 131 | 2500 | CGGGCAUCGCCACCAGAGA | 3077 | UCUCUGGUGGCGAUGCCCG |
| 132 | 2501 | GGGCAUCGCCACCAGAGAA | 3078 | UUCUCUGGUGGCGAUGCCC |
| 133 | 2502 | GGCAUCGCCACCAGAGAAC | 3079 | GUUCUCUGGUGGCGAUGCC |
| 134 | 2503 | GCAUCGCCACCAGAGAACG | 3080 | CGUUCUCUGGUGGCGAUGC |
| 135 | 2504 | CAUCGCCACCAGAGAACGG | 3081 | CCGUUCUCUGGUGGCGAUG |
| 136 | 2505 | AUCGCCACCAGAGAACGGC | 3082 | GCCGUUCUCUGGUGGCGAU |
| 137 | 2506 | UCGCCACCAGAGAACGGCU | 3083 | AGCCGUUCUCUGGUGGCGA |
| 138 | 2507 | CGCCACCAGAGAACGGCUG | 3084 | CAGCCGUUCUCUGGUGGCG |
| 144 | 2508 | CAGAGAACGGCUGGCCCAG | 3085 | CUGGGCCAGCCGUUCUCUG |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 145 | 2509 | AGAGAACGGCUGGCCCAGG | 3086 | CCUGGGCCAGCCGUUCUCU |
| 146 | 2510 | GAGAACGGCUGGCCCAGGC | 3087 | GCCUGGGCCAGCCGUUCUC |
| 147 | 2511 | AGAACGGCUGGCCCAGGCC | 3088 | GGCCUGGGCCAGCCGUUCU |
| 148 | 2512 | GAACGGCUGGCCCAGGCCA | 3089 | UGGCCUGGGCCAGCCGUUC |
| 157 | 2513 | GCCCAGGCCAUCGGCAUUC | 3090 | GAAUGCCGAUGGCCUGGGC |
| 158 | 2514 | CCCAGGCCAUCGGCAUUCC | 3091 | GGAAUGCCGAUGGCCUGGG |
| 159 | 2515 | CCAGGCCAUCGGCAUUCCG | 3092 | CGGAAUGCCGAUGGCCUGG |
| 160 | 2516 | CAGGCCAUCGGCAUUCCGG | 3093 | CCGGAAUGCCGAUGGCCUG |
| 161 | 2517 | AGGCCAUCGGCAUUCCGGA | 3094 | UCCGGAAUGCCGAUGGCCU |
| 162 | 2518 | GGCCAUCGGCAUUCCGGAG | 3095 | CUCCGGAAUGCCGAUGGCC |
| 163 | 2519 | GCCAUCGGCAUUCCGGAGC | 3096 | GCUCCGGAAUGCCGAUGGC |
| 164 | 2520 | CCAUCGGCAUUCCGGAGCC | 3097 | GGCUCCGGAAUGCCGAUGG |
| 165 | 2521 | CAUCGGCAUUCCGGAGCCC | 3098 | GGGCUCCGGAAUGCCGAUG |
| 166 | 2522 | AUCGGCAUUCCGGAGCCCA | 3099 | UGGGCUCCGGAAUGCCGAU |
| 167 | 2523 | UCGGCAUUCCGGAGCCCAG | 3100 | CUGGGCUCCGGAAUGCCGA |
| 168 | 2524 | CGGCAUUCCGGAGCCCAGG | 3101 | CCUGGGCUCCGGAAUGCCG |
| 169 | 2525 | GGCAUUCCGGAGCCCAGGG | 3102 | CCCUGGGCUCCGGAAUGCC |
| 170 | 2526 | GCAUUCCGGAGCCCAGGGU | 3103 | ACCCUGGGCUCCGGAAUGC |
| 171 | 2527 | CAUUCCGGAGCCCAGGGUC | 3104 | GACCCUGGGCUCCGGAAUG |
| 172 | 2528 | AUUCCGGAGCCCAGGGUCC | 3105 | GGACCCUGGGCUCCGGAAU |
| 173 | 2529 | UUCCGGAGCCCAGGGUCCA | 3106 | UGGACCCUGGGCUCCGGAA |
| 174 | 2530 | UCCGGAGCCCAGGGUCCAG | 3107 | CUGGACCCUGGGCUCCGGA |
| 175 | 2531 | CCGGAGCCCAGGGUCCAGA | 3108 | UCUGGACCCUGGGCUCCGG |
| 176 | 2532 | CGGAGCCCAGGGUCCAGAU | 3109 | AUCUGGACCCUGGGCUCCG |
| 177 | 2533 | GGAGCCCAGGGUCCAGAUU | 3110 | AAUCUGGACCCUGGGCUCC |
| 186 | 2534 | GGUCCAGAUUUGGUUUCAG | 3111 | CUGAAACCAAAUCUGGACC |
| 187 | 2535 | GUCCAGAUUUGGUUUCAGA | 3112 | UCUGAAACCAAAUCUGGAC |
| 188 | 2536 | UCCAGAUUUGGUUUCAGAA | 3113 | UUCUGAAACCAAAUCUGGA |
| 189 | 2537 | CCAGAUUUGGUUUCAGAAU | 3114 | AUUCUGAAACCAAAUCUGG |
| 190 | 2538 | CAGAUUUGGUUUCAGAAUG | 3115 | CAUUCUGAAACCAAAUCUG |
| 192 | 2539 | GAUUUGGUUUCAGAAUGAG | 3116 | CUCAUUCUGAAACCAAAUC |
| 194 | 2540 | UUUGGUUUCAGAAUGAGAG | 3117 | CUCUCAUUCUGAAACCAAA |
| 195 | 2541 | UUGGUUUCAGAAUGAGAGG | 3118 | CCUCUCAUUCUGAAACCAA |
| 196 | 2542 | UGGUUUCAGAAUGAGAGGU | 3119 | ACCUCUCAUUCUGAAACCA |
| 197 | 2543 | GGUUUCAGAAUGAGAGGUC | 3120 | GACCUCUCAUUCUGAAACC |
| 198 | 2544 | GUUUCAGAAUGAGAGGUCA | 3121 | UGACCUCUCAUUCUGAAAC |
| 199 | 2545 | UUUCAGAAUGAGAGGUCAC | 3122 | GUGACCUCUCAUUCUGAAA |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 200 | 2546 | UUCAGAAUGAGAGGUCACG | 3123 | CGUGACCUCUCAUUCUGAA |
| 201 | 2547 | UCAGAAUGAGAGGUCACGC | 3124 | GCGUGACCUCUCAUUCUGA |
| 202 | 2548 | CAGAAUGAGAGGUCACGCC | 3125 | GGCGUGACCUCUCAUUCUG |
| 203 | 2549 | AGAAUGAGAGGUCACGCCA | 3126 | UGGCGUGACCUCUCAUUCU |
| 204 | 2550 | GAAUGAGAGGUCACGCCAG | 3127 | CUGGCGUGACCUCUCAUUC |
| 205 | 2551 | AAUGAGAGGUCACGCCAGC | 3128 | GCUGGCGUGACCUCUCAUU |
| 206 | 2552 | AUGAGAGGUCACGCCAGCU | 3129 | AGCUGGCGUGACCUCUCAU |
| 207 | 2553 | UGAGAGGUCACGCCAGCUG | 3130 | CAGCUGGCGUGACCUCUCA |
| 208 | 2554 | GAGAGGUCACGCCAGCUGA | 3131 | UCAGCUGGCGUGACCUCUC |
| 209 | 2555 | AGAGGUCACGCCAGCUGAG | 3132 | CUCAGCUGGCGUGACCUCU |
| 210 | 2556 | GAGGUCACGCCAGCUGAGG | 3133 | CCUCAGCUGGCGUGACCUC |
| 211 | 2557 | AGGUCACGCCAGCUGAGGC | 3134 | GCCUCAGCUGGCGUGACCU |
| 212 | 2558 | GGUCACGCCAGCUGAGGCA | 3135 | UGCCUCAGCUGGCGUGACC |
| 213 | 2559 | GUCACGCCAGCUGAGGCAG | 3136 | CUGCCUCAGCUGGCGUGAC |
| 214 | 2560 | UCACGCCAGCUGAGGCAGC | 3137 | GCUGCCUCAGCUGGCGUGA |
| 215 | 2561 | CACGCCAGCUGAGGCAGCA | 3138 | UGCUGCCUCAGCUGGCGUG |
| 224 | 2562 | UGAGGCAGCACCGGCGGGA | 3139 | UCCCGCCGGUGCUGCCUCA |
| 225 | 129 | GAGGCAGCACCGGGGGGAA | 3140 | UUCCCGCCGGUGCUGCCUC |
| 226 | 2563 | AGGCAGCACCGGCGGGAAU | 3141 | AUUCCCGCCGGUGCUGCCU |
| 227 | 2564 | GGCAGCACCGGCGGGAAUC | 3142 | GAUUCCCGCCGGUGCUGCC |
| 228 | 2565 | GCAGCACCGGGGGGAAUCU | 3143 | AGAUUCCCGCCGGUGCUGC |
| 229 | 2566 | CAGCACCGGGGGGAAUCUC | 3144 | GAGAUUCCCGCCGGUGCUG |
| 230 | 2567 | AGCACCGGCGGGAAUCUCG | 3145 | CGAGAUUCCCGCCGGUGCU |
| 231 | 2568 | GCACCGGCGGGAAUCUCGG | 3146 | CCGAGAUUCCCGCCGGUGC |
| 232 | 2569 | CACCGGGGGGAAUCUCGGC | 3147 | GCCGAGAUUCCCGCCGGUG |
| 235 | 2570 | CGGCGGGAAUCUCGGCCCU | 3148 | AGGGCCGAGAUUCCCGCCG |
| 236 | 2571 | GGCGGGAAUCUCGGCCCUG | 3149 | CAGGGCCGAGAUUCCCGCC |
| 237 | 2572 | GCGGGAAUCUCGGCCCUGG | 3150 | CCAGGGCCGAGAUUCCCGC |
| 238 | 2573 | CGGGAAUCUCGGCCCUGGC | 3151 | GCCAGGGCCGAGAUUCCCG |
| 239 | 2574 | GGGAAUCUCGGCCCUGGCC | 3152 | GGCCAGGGCCGAGAUUCCC |
| 240 | 2575 | GGAAUCUCGGCCCUGGCCC | 3153 | GGGCCAGGGCCGAGAUUCC |
| 241 | 2576 | GAAUCUCGGCCCUGGCCCG | 3154 | CGGGCCAGGGCCGAGAUUC |
| 261 | 144 | GAGACGCGGCCCGCCAGAA | 3155 | UUCUGGCGGGCCGCGUCUC |
| 262 | 145 | AGACGCGGCCCGCCAGAAG | 3156 | CUUCUGGGGGGCCGCGUCU |
| 273 | 146 | GCCAGAAGGCCGGCGAAAG | 3157 | CUUUCGCCGGCCUUCUGGC |
| 274 | 147 | CCAGAAGGCCGGCGAAAGC | 3158 | GCUUUCGCCGGCCUUCUGG |
| 275 | 148 | CAGAAGGCCGGCGAAAGCG | 3159 | CGCUUUCGCCGGCCUUCUG |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 276 | 149 | AGAAGGCCGGCGAAAGCGG | 3160 | CCGCUUUCGCCGGCCUUCU |
| 277 | 150 | GAAGGCCGGCGAAAGCGGA | 3161 | UCCGCUUUCGCCGGCCUUC |
| 278 | 151 | AAGGCCGGCGAAAGCGGAC | 3162 | GUCCGCUUUCGCCGGCCUU |
| 285 | 2577 | GCGAAAGCGGACCGCCGUC | 3163 | GACGGCGGUCCGCUUUCGC |
| 286 | 2578 | CGAAAGCGGACCGCCGUCA | 3164 | UGACGGCGGUCCGCUUUCG |
| 287 | 2579 | GAAAGCGGACCGCCGUCAC | 3165 | GUGACGGCGGUCCGCUUUC |
| 288 | 2580 | AAAGCGGACCGCCGUCACC | 3166 | GGUGACGGCGGUCCGCUUU |
| 289 | 2581 | AAGCGGACCGCCGUCACCG | 3167 | CGGUGACGGCGGUCCGCUU |
| 292 | 2582 | CGGACCGCCGUCACCGGAU | 3168 | AUCCGGUGACGGCGGUCCG |
| 293 | 2583 | GGACCGCCGUCACCGGAUC | 3169 | GAUCCGGUGACGGCGGUCC |
| 294 | 2584 | GACCGCCGUCACCGGAUCC | 3170 | GGAUCCGGUGACGGCGGUC |
| 295 | 2585 | ACCGCCGUCACCGGAUCCC | 3171 | GGGAUCCGGUGACGGCGGU |
| 296 | 2586 | CCGCCGUCACCGGAUCCCA | 3172 | UGGGAUCCGGUGACGGCGG |
| 297 | 2587 | CGCCGUCACCGGAUCCCAG | 3173 | CUGGGAUCCGGUGACGGCG |
| 298 | 2588 | GCCGUCACCGGAUCCCAGA | 3174 | UCUGGGAUCCGGUGACGGC |
| 299 | 2589 | CCGUCACCGGAUCCCAGAC | 3175 | GUCUGGGAUCCGGUGACGG |
| 300 | 2590 | CGUCACCGGAUCCCAGACC | 3176 | GGUCUGGGAUCCGGUGACG |
| 301 | 2591 | GUCACCGGAUCCCAGACCG | 3177 | CGGUCUGGGAUCCGGUGAC |
| 302 | 2592 | UCACCGGAUCCCAGACCGC | 3178 | GCGGUCUGGGAUCCGGUGA |
| 303 | 2593 | CACCGGAUCCCAGACCGCC | 3179 | GGCGGUCUGGGAUCCGGUG |
| 304 | 2594 | ACCGGAUCCCAGACCGCCC | 3180 | GGGCGGUCUGGGAUCCGGU |
| 305 | 2595 | CCGGAUCCCAGACCGCCCU | 3181 | AGGGCGGUCUGGGAUCCGG |
| 306 | 2596 | CGGAUCCCAGACCGCCCUG | 3182 | CAGGGCGGUCUGGGAUCCG |
| 307 | 2597 | GGAUCCCAGACCGCCCUGC | 3183 | GCAGGGCGGUCUGGGAUCC |
| 308 | 2598 | GAUCCCAGACCGCCCUGCU | 3184 | AGCAGGGCGGUCUGGGAUC |
| 309 | 2599 | AUCCCAGACCGCCCUGCUC | 3185 | GAGCAGGGCGGUCUGGGAU |
| 310 | 2600 | UCCCAGACCGCCCUGCUCC | 3186 | GGAGCAGGGCGGUCUGGGA |
| 311 | 2601 | CCCAGACCGCCCUGCUCCU | 3187 | AGGAGCAGGGCGGUCUGGG |
| 312 | 2602 | CCAGACCGCCCUGCUCCUC | 3188 | GAGGAGCAGGGCGGUCUGG |
| 313 | 2603 | CAGACCGCCCUGCUCCUCC | 3189 | GGAGGAGCAGGGCGGUCUG |
| 314 | 2604 | AGACCGCCCUGCUCCUCCG | 3190 | CGGAGGAGCAGGGCGGUCU |
| 315 | 2605 | GACCGCCCUGCUCCUCCGA | 3191 | UCGGAGGAGCAGGGCGGUC |
| 316 | 2606 | ACCGCCCUGCUCCUCCGAG | 3192 | CUCGGAGGAGCAGGGCGGU |
| 325 | 2607 | CUCCUCCGAGCCUUUGAGA | 3193 | UCUCAAAGGCUCGGAGGAG |
| 328 | 2608 | CUCCGAGCCUUUGAGAAGG | 3194 | CCUUCUCAAAGGCUCGGAG |
| 336 | 2609 | CUUUGAGAAGGAUCGCUUU | 3195 | AAAGCGAUCCUUCUCAAAG |
| 337 | 2610 | UUUGAGAAGGAUCGCUUUC | 3196 | GAAAGCGAUCCUUCUCAAA |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 338 | 2611 | UUGAGAAGGAUCGCUUUCC | 3197 | GGAAAGCGAUCCUUCUCAA |
| 339 | 2612 | UGAGAAGGAUCGCUUUCCA | 3198 | UGGAAAGCGAUCCUUCUCA |
| 340 | 2613 | GAGAAGGAUCGCUUUCCAG | 3199 | CUGGAAAGCGAUCCUUCUC |
| 341 | 2614 | AGAAGGAUCGCUUUCCAGG | 3200 | CCUGGAAAGCGAUCCUUCU |
| 342 | 2615 | GAAGGAUCGCUUUCCAGGC | 3201 | GCCUGGAAAGCGAUCCUUC |
| 343 | 2616 | AAGGAUCGCUUUCCAGGCA | 3202 | UGCCUGGAAAGCGAUCCUU |
| 344 | 2617 | AGGAUCGCUUUCCAGGCAU | 3203 | AUGCCUGGAAAGCGAUCCU |
| 345 | 2618 | GGAUCGCUUUCCAGGCAUC | 3204 | GAUGCCUGGAAAGCGAUCC |
| 346 | 2619 | GAUCGCUUUCCAGGCAUCG | 3205 | CGAUGCCUGGAAAGCGAUC |
| 347 | 2620 | AUCGCUUUCCAGGCAUCGC | 3206 | GCGAUGCCUGGAAAGCGAU |
| 348 | 2621 | UCGCUUUCCAGGCAUCGCC | 3207 | GGCGAUGCCUGGAAAGCGA |
| 349 | 2622 | CGCUUUCCAGGCAUCGCCG | 3208 | CGGCGAUGCCUGGAAAGCG |
| 350 | 2623 | GCUUUCCAGGCAUCGCCGC | 3209 | GCGGCGAUGCCUGGAAAGC |
| 351 | 2624 | CUUUCCAGGCAUCGCCGCC | 3210 | GGCGGCGAUGCCUGGAAAG |
| 352 | 2625 | UUUCCAGGCAUCGCCGCCC | 3211 | GGGCGGCGAUGCCUGGAAA |
| 353 | 2626 | UUCCAGGCAUCGCCGCCCG | 3212 | CGGGCGGCGAUGCCUGGAA |
| 369 | 2627 | CCGGGAGGAGCUGGCCAGA | 3213 | UCUGGCCAGCUCCUCCCGG |
| 370 | 2628 | CGGGAGGAGCUGGCCAGAG | 3214 | CUCUGGCCAGCUCCUCCCG |
| 371 | 2629 | GGGAGGAGCUGGCCAGAGA | 3215 | UCUCUGGCCAGCUCCUCCC |
| 372 | 2630 | GGAGGAGCUGGCCAGAGAG | 3216 | CUCUCUGGCCAGCUCCUCC |
| 373 | 2631 | GAGGAGCUGGCCAGAGAGA | 3217 | UCUCUCUGGCCAGCUCCUC |
| 374 | 2632 | AGGAGCUGGCCAGAGAGAC | 3218 | GUCUCUCUGGCCAGCUCCU |
| 375 | 2633 | GGAGCUGGCCAGAGAGACG | 3219 | CGUCUCUCUGGCCAGCUCC |
| 376 | 2634 | GAGCUGGCCAGAGAGACGG | 3220 | CCGUCUCUCUGGCCAGCUC |
| 377 | 2635 | AGCUGGCCAGAGAGACGGG | 3221 | CCCGUCUCUCUGGCCAGCU |
| 378 | 2636 | GCUGGCCAGAGAGACGGGC | 3222 | GCCCGUCUCUCUGGCCAGC |
| 382 | 2637 | GCCAGAGAGACGGGCCUCC | 3223 | GGAGGCCCGUCUCUCUGGC |
| 383 | 2638 | CCAGAGAGACGGGCCUCCC | 3224 | GGGAGGCCCGUCUCUCUGG |
| 384 | 2639 | CAGAGAGACGGGCCUCCCG | 3225 | CGGGAGGCCCGUCUCUCUG |
| 385 | 2640 | AGAGAGACGGGCCUCCCGG | 3226 | CCGGGAGGCCCGUCUCUCU |
| 394 | 2641 | GGCCUCCCGGAGUCCAGGA | 3227 | UCCUGGACUCCGGGAGGCC |
| 395 | 2642 | GCCUCCCGGAGUCCAGGAU | 3228 | AUCCUGGACUCCGGGAGGC |
| 396 | 2643 | CCUCCCGGAGUCCAGGAUU | 3229 | AAUCCUGGACUCCGGGAGG |
| 397 | 2644 | CUCCCGGAGUCCAGGAUUC | 3230 | GAAUCCUGGACUCCGGGAG |
| 398 | 2645 | UCCCGGAGUCCAGGAUUCA | 3231 | UGAAUCCUGGACUCCGGGA |
| 399 | 2646 | CCCGGAGUCCAGGAUUCAG | 3232 | CUGAAUCCUGGACUCCGGG |
| 400 | 2647 | CCGGAGUCCAGGAUUCAGA | 3233 | UCUGAAUCCUGGACUCCGG |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 401 | 2648 | CGGAGUCCAGGAUUCAGAU | 3234 | AUCUGAAUCCUGGACUCCG |
| 402 | 2649 | GGAGUCCAGGAUUCAGAUC | 3235 | GAUCUGAAUCCUGGACUCC |
| 403 | 2650 | GAGUCCAGGAUUCAGAUCU | 3236 | AGAUCUGAAUCCUGGACUC |
| 404 | 2651 | AGUCCAGGAUUCAGAUCUG | 3237 | CAGAUCUGAAUCCUGGACU |
| 408 | 2652 | CAGGAUUCAGAUCUGGUUU | 3238 | AAACCAGAUCUGAAUCCUG |
| 409 | 2653 | AGGAUUCAGAUCUGGUUUC | 3239 | GAAACCAGAUCUGAAUCCU |
| 410 | 2654 | GGAUUCAGAUCUGGUUUCA | 3240 | UGAAACCAGAUCUGAAUCC |
| 411 | 2655 | GAUUCAGAUCUGGUUUCAG | 3241 | CUGAAACCAGAUCUGAAUC |
| 412 | 2656 | AUUCAGAUCUGGUUUCAGA | 3242 | UCUGAAACCAGAUCUGAAU |
| 420 | 2657 | CUGGUUUCAGAAUCGAAGG | 3243 | CCUUCGAUUCUGAAACCAG |
| 421 | 2658 | UGGUUUCAGAAUCGAAGGG | 3244 | CCCUUCGAUUCUGAAACCA |
| 422 | 2659 | GGUUUCAGAAUCGAAGGGC | 3245 | GCCCUUCGAUUCUGAAACC |
| 423 | 2660 | GUUUCAGAAUCGAAGGGCC | 3246 | GGCCCUUCGAUUCUGAAAC |
| 424 | 2661 | UUUCAGAAUCGAAGGGCCA | 3247 | UGGCCCUUCGAUUCUGAAA |
| 425 | 2662 | UUCAGAAUCGAAGGGCCAG | 3248 | CUGGCCCUUCGAUUCUGAA |
| 426 | 2663 | UCAGAAUCGAAGGGCCAGG | 3249 | CCUGGCCCUUCGAUUCUGA |
| 427 | 2664 | CAGAAUCGAAGGGCCAGGC | 3250 | GCCUGGCCCUUCGAUUCUG |
| 428 | 2665 | AGAAUCGAAGGGCCAGGCA | 3251 | UGCCUGGCCCUUCGAUUCU |
| 429 | 2666 | GAAUCGAAGGGCCAGGCAC | 3252 | GUGCCUGGCCCUUCGAUUC |
| 430 | 2667 | AAUCGAAGGGCCAGGCACC | 3253 | GGUGCCUGGCCCUUCGAUU |
| 431 | 2668 | AUCGAAGGGCCAGGCACCC | 3254 | GGGUGCCUGGCCCUUCGAU |
| 432 | 2669 | UCGAAGGGCCAGGCACCCG | 3255 | CGGGUGCCUGGCCCUUCGA |
| 509 | 2670 | GGGGUCACCCUGCUCCCUC | 3256 | GAGGGAGCAGGGUGACCCC |
| 510 | 2671 | GGGUCACCCUGCUCCCUCG | 3257 | CGAGGGAGCAGGGUGACCC |
| 511 | 2672 | GGUCACCCUGCUCCCUCGU | 3258 | ACGAGGGAGCAGGGUGACC |
| 512 | 2673 | GUCACCCUGCUCCCUCGUG | 3259 | CACGAGGGAGCAGGGUGAC |
| 513 | 2674 | UCACCCUGCUCCCUCGUGG | 3260 | CCACGAGGGAGCAGGGUGA |
| 514 | 2675 | CACCCUGCUCCCUCGUGGG | 3261 | CCCACGAGGGAGCAGGGUG |
| 516 | 2676 | CCCUGCUCCCUCGUGGGUC | 857 | GACCCACGAGGGAGCAGGG |
| 517 | 2677 | CCUGCUCCCUCGUGGGUCG | 858 | CGACCCACGAGGGAGCAGG |
| 518 | 2678 | CUGCUCCCUCGUGGGUCGC | 859 | GCGACCCACGAGGGAGCAG |
| 519 | 2679 | UGCUCCCUCGUGGGUCGCC | 860 | GGCGACCCACGAGGGAGCA |
| 520 | 2680 | GCUCCCUCGUGGGUCGCCU | 861 | AGGCGACCCACGAGGGAGC |
| 521 | 2681 | CUCCCUCGUGGGUCGCCUU | 862 | AAGGCGACCCACGAGGGAG |
| 522 | 2682 | UCCCUCGUGGGUCGCCUUC | 863 | GAAGGCGACCCACGAGGGA |
| 523 | 2683 | CCCUCGUGGGUCGCCUUCG | 864 | CGAAGGCGACCCACGAGGG |
| 524 | 2684 | CCUCGUGGGUCGCCUUCGC | 865 | GCGAAGGCGACCCACGAGG |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 525 | 2685 | CUCGUGGGUCGCCUUCGCC | 866 | GGCGAAGGCGACCCACGAG |
| 526 | 2686 | UCGUGGGUCGCCUUCGCCC | 867 | GGGCGAAGGCGACCCACGA |
| 530 | 2687 | GGGUCGCCUUCGCCCACAC | 3262 | GUGUGGGCGAAGGCGACCC |
| 531 | 2688 | GGUCGCCUUCGCCCACACC | 3263 | GGUGUGGGCGAAGGCGACC |
| 532 | 2689 | GUCGCCUUCGCCCACACCG | 3264 | CGGUGUGGGCGAAGGCGAC |
| 533 | 2690 | UCGCCUUCGCCCACACCGG | 3265 | CCGGUGUGGGCGAAGGCGA |
| 544 | 2691 | CACACCGGCGCGUGGGGAA | 3266 | UUCCCCACGCGCCGGUGUG |
| 545 | 2692 | ACACCGGCGCGUGGGGAAC | 3267 | GUUCCCCACGCGCCGGUGU |
| 552 | 2693 | CGCGUGGGGAACGGGGCUU | 3268 | AAGCCCCGUUCCCCACGCG |
| 553 | 2694 | GCGUGGGGAACGGGGCUUC | 3269 | GAAGCCCCGUUCCCCACGC |
| 566 | 2695 | GGCUUCCCGCACCCCACGU | 3270 | ACGUGGGGUGCGGGAAGCC |
| 567 | 2696 | GCUUCCCGCACCCCACGUG | 3271 | CACGUGGGGUGCGGGAAGC |
| 619 | 2697 | UUCGUGAGCCAGGCAGCGA | 3272 | UCGCUGCCUGGCUCACGAA |
| 620 | 2698 | UCGUGAGCCAGGCAGCGAG | 3273 | CUCGCUGCCUGGCUCACGA |
| 621 | 2699 | CGUGAGCCAGGCAGCGAGG | 3274 | CCUCGCUGCCUGGCUCACG |
| 622 | 2700 | GUGAGCCAGGCAGCGAGGG | 3275 | CCCUCGCUGCCUGGCUCAC |
| 671 | 2701 | CGCCGGCAGAGGGGAUCUC | 3276 | GAGAUCCCCUCUGCCGGCG |
| 672 | 2702 | GCCGGCAGAGGGGAUCUCC | 3277 | GGAGAUCCCCUCUGCCGGC |
| 673 | 2703 | CCGGCAGAGGGGAUCUCCC | 3278 | GGGAGAUCCCCUCUGCCGG |
| 674 | 2704 | CGGCAGAGGGGAUCUCCCA | 3279 | UGGGAGAUCCCCUCUGCCG |
| 675 | 2705 | GGCAGAGGGGAUCUCCCAA | 3280 | UUGGGAGAUCCCCUCUGCC |
| 683 | 2706 | GGAUCUCCCAACCUGCCCC | 3281 | GGGGCAGGUUGGGAGAUCC |
| 684 | 2707 | GAUCUCCCAACCUGCCCCG | 3282 | CGGGGCAGGUUGGGAGAUC |
| 685 | 2708 | AUCUCCCAACCUGCCCCGG | 3283 | CCGGGGCAGGUUGGGAGAU |
| 686 | 2709 | UCUCCCAACCUGCCCCGGC | 3284 | GCCGGGGCAGGUUGGGAGA |
| 706 | 2710 | CGCGGGGAUUUCGCCUACG | 3285 | CGUAGGCGAAAUCCCCGCG |
| 707 | 2711 | GCGGGGAUUUCGCCUACGC | 3286 | GCGUAGGCGAAAUCCCCGC |
| 708 | 2712 | CGGGGAUUUCGCCUACGCC | 3287 | GGCGUAGGCGAAAUCCCCG |
| 709 | 2713 | GGGGAUUUCGCCUACGCCG | 3288 | CGGCGUAGGCGAAAUCCCC |
| 710 | 2714 | GGGAUUUCGCCUACGCCGC | 3289 | GCGGCGUAGGCGAAAUCCC |
| 711 | 2715 | GGAUUUCGCCUACGCCGCC | 3290 | GGCGGCGUAGGCGAAAUCC |
| 712 | 2716 | GAUUUCGCCUACGCCGCCC | 3291 | GGGCGGCGUAGGCGAAAUC |
| 713 | 2717 | AUUUCGCCUACGCCGCCCC | 3292 | GGGGCGGCGUAGGCGAAAU |
| 714 | 2718 | UUUCGCCUACGCCGCCCCG | 3293 | CGGGGCGGCGUAGGCGAAA |
| 746 | 2719 | GGGCGCUCUCCCACCCUCA | 3294 | UGAGGGUGGGAGAGCGCCC |
| 747 | 2720 | GGCGCUCUCCCACCCUCAG | 3295 | CUGAGGGUGGGAGAGCGCC |
| 748 | 2721 | GCGCUCUCCCACCCUCAGG | 3296 | CCUGAGGGUGGGAGAGCGC |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 749 | 2722 | CGCUCUCCCACCCUCAGGC | 3297 | GCCUGAGGGUGGGAGAGCG |
| 750 | 2723 | GCUCUCCCACCCUCAGGCU | 3298 | AGCCUGAGGGUGGGAGAGC |
| 751 | 2724 | CUCUCCCACCCUCAGGCUC | 3299 | GAGCCUGAGGGUGGGAGAG |
| 752 | 2725 | UCUCCCACCCUCAGGCUCC | 3300 | GGAGCCUGAGGGUGGGAGA |
| 753 | 2726 | CUCCCACCCUCAGGCUCCU | 3301 | AGGAGCCUGAGGGUGGGAG |
| 754 | 2727 | UCCCACCCUCAGGCUCCUC | 3302 | GAGGAGCCUGAGGGUGGGA |
| 755 | 2728 | CCCACCCUCAGGCUCCUCG | 3303 | CGAGGAGCCUGAGGGUGGG |
| 756 | 2729 | CCACCCUCAGGCUCCUCGG | 3304 | CCGAGGAGCCUGAGGGUGG |
| 757 | 2730 | CACCCUCAGGCUCCUCGGU | 3305 | ACCGAGGAGCCUGAGGGUG |
| 758 | 2731 | ACCCUCAGGCUCCUCGGUG | 3306 | CACCGAGGAGCCUGAGGGU |
| 759 | 2732 | CCCUCAGGCUCCUCGGUGG | 3307 | CCACCGAGGAGCCUGAGGG |
| 760 | 2733 | CCUCAGGCUCCUCGGUGGC | 3308 | GCCACCGAGGAGCCUGAGG |
| 761 | 2734 | CUCAGGCUCCUCGGUGGCC | 3309 | GGCCACCGAGGAGCCUGAG |
| 767 | 2735 | CUCCUCGGUGGCCUCCGCA | 3310 | UGCGGAGGCCACCGAGGAG |
| 768 | 2736 | UCCUCGGUGGCCUCCGCAC | 3311 | GUGCGGAGGCCACCGAGGA |
| 777 | 2737 | GCCUCCGCACCCGGGCAAA | 3312 | UUUGCCCGGGUGCGGAGGC |
| 778 | 2738 | CCUCCGCACCCGGGCAAAA | 3313 | UUUUGCCCGGGUGCGGAGG |
| 779 | 2739 | CUCCGCACCCGGGCAAAAG | 3314 | CUUUUGCCCGGGUGCGGAG |
| 780 | 2740 | UCCGCACCCGGGCAAAAGC | 3315 | GCUUUUGCCCGGGUGCGGA |
| 781 | 316 | CCGCACCCGGGCAAAAGCC | 3316 | GGCUUUUGCCCGGGUGCGG |
| 782 | 317 | CGCACCCGGGCAAAAGCCG | 3317 | CGGCUUUUGCCCGGGUGCG |
| 788 | 318 | CGGGCAAAAGCCGGGAGGA | 3318 | UCCUCCCGGCUUUUGCCCG |
| 789 | 319 | GGGCAAAAGCCGGGAGGAC | 3319 | GUCCUCCCGGCUUUUGCCC |
| 790 | 320 | GGCAAAAGCCGGGAGGACC | 3320 | GGUCCUCCCGGCUUUUGCC |
| 791 | 321 | GCAAAAGCCGGGAGGACCG | 3321 | CGGUCCUCCCGGCUUUUGC |
| 840 | 2741 | CUGCGCGGUGGCACAGCCU | 3322 | AGGCUGUGCCACCGCGCAG |
| 841 | 2742 | UGCGCGGUGGCACAGCCUG | 3323 | CAGGCUGUGCCACCGCGCA |
| 851 | 2743 | CACAGCCUGGGCCCGCUCA | 3324 | UGAGCGGGCCCAGGCUGUG |
| 852 | 2744 | ACAGCCUGGGCCCGCUCAA | 3325 | UUGAGCGGGCCCAGGCUGU |
| 853 | 2745 | CAGCCUGGGCCCGCUCAAG | 3326 | CUUGAGCGGGCCCAGGCUG |
| 854 | 2746 | AGCCUGGGCCCGCUCAAGC | 3327 | GCUUGAGCGGGCCCAGGCU |
| 878 | 2747 | CGCAGGGCCAAGGGGUGCU | 3328 | AGCACCCCUUGGCCCUGCG |
| 879 | 2748 | GCAGGGCCAAGGGGUGCUU | 3329 | AAGCACCCCUUGGCCCUGC |
| 901 | 2749 | CCACCCACGUCCCAGGGGA | 3330 | UCCCCUGGGACGUGGGUGG |
| 902 | 2750 | CACCCACGUCCCAGGGGAG | 3331 | CUCCCCUGGGACGUGGGUG |
| 903 | 2751 | ACCCACGUCCCAGGGGAGU | 3332 | ACUCCCCUGGGACGUGGGU |
| 911 | 2752 | CCCAGGGGAGUCCGUGGUG | 3333 | CACCACGGACUCCCCUGGG |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 912 | 2753 | CCAGGGGAGUCCGUGGUGG | 3334 | CCACCACGGACUCCCCUGG |
| 913 | 2754 | CAGGGGAGUCCGUGGUGGG | 3335 | CCCACCACGGACUCCCCUG |
| 914 | 2755 | AGGGGAGUCCGUGGUGGGG | 3336 | CCCCACCACGGACUCCCCU |
| 960 | 2756 | GGCGGCGUGGGAACCCCAA | 3337 | UUGGGGUUCCCACGCCGCC |
| 975 | 2757 | CCAAGCCGGGGCAGCUCCA | 3338 | UGGAGCUGCCCCGGCUUGG |
| 976 | 2758 | CAAGCCGGGGCAGCUCCAC | 3339 | GUGGAGCUGCCCCGGCUUG |
| 977 | 2759 | AAGCCGGGGCAGCUCCACC | 3340 | GGUGGAGCUGCCCCGGCUU |
| 983 | 2760 | GGGCAGCUCCACCUCCCCA | 3341 | UGGGGAGGUGGAGCUGCCC |
| 984 | 2761 | GGCAGCUCCACCUCCCCAG | 3342 | CUGGGGAGGUGGAGCUGCC |
| 985 | 2762 | GCAGCUCCACCUCCCCAGC | 3343 | GCUGGGGAGGUGGAGCUGC |
| 986 | 2763 | CAGCUCCACCUCCCCAGCC | 3344 | GGCUGGGGAGGUGGAGCUG |
| 1031 | 2764 | CGCGGCAGGGGCAGAUGCA | 3345 | UGCAUCUGCCCCUGCCGCG |
| 1033 | 2765 | CGGCAGGGGCAGAUGCAAG | 3346 | CUUGCAUCUGCCCCUGCCG |
| 1034 | 2766 | GGCAGGGGCAGAUGCAAGG | 3347 | CCUUGCAUCUGCCCCUGCC |
| 1035 | 2767 | GCAGGGGCAGAUGCAAGGC | 3348 | GCCUUGCAUCUGCCCCUGC |
| 1036 | 2768 | CAGGGGCAGAUGCAAGGCA | 3349 | UGCCUUGCAUCUGCCCCUG |
| 1037 | 2769 | AGGGGCAGAUGCAAGGCAU | 3350 | AUGCCUUGCAUCUGCCCCU |
| 1046 | 2770 | UGCAAGGCAUCCCGGCGCC | 3351 | GGCGCCGGGAUGCCUUGCA |
| 1048 | 2771 | CAAGGCAUCCCGGCGCCCU | 3352 | AGGGCGCCGGGAUGCCUUG |
| 1049 | 2772 | AAGGCAUCCCGGCGCCCUC | 3353 | GAGGGCGCCGGGAUGCCUU |
| 1064 | 2773 | CCUCCCAGGCGCUCCAGGA | 3354 | UCCUGGAGCGCCUGGGAGG |
| 1086 | 2774 | GGCGCCCUGGUCUGCACUC | 3355 | GAGUGCAGACCAGGGCGCC |
| 1087 | 2775 | GCGCCCUGGUCUGCACUCC | 3356 | GGAGUGCAGACCAGGGCGC |
| 1088 | 2776 | CGCCCUGGUCUGCACUCCC | 3357 | GGGAGUGCAGACCAGGGCG |
| 1089 | 2777 | GCCCUGGUCUGCACUCCCC | 3358 | GGGGAGUGCAGACCAGGGC |
| 1090 | 2778 | CCCUGGUCUGCACUCCCCU | 3359 | AGGGGAGUGCAGACCAGGG |
| 1091 | 2779 | CCUGGUCUGCACUCCCCUG | 3360 | CAGGGGAGUGCAGACCAGG |
| 1092 | 2780 | CUGGUCUGCACUCCCCUGC | 3361 | GCAGGGGAGUGCAGACCAG |
| 1093 | 2781 | UGGUCUGCACUCCCCUGCG | 3362 | CGCAGGGGAGUGCAGACCA |
| 1094 | 2782 | GGUCUGCACUCCCCUGCGG | 3363 | CCGCAGGGGAGUGCAGACC |
| 1095 | 2783 | GUCUGCACUCCCCUGCGGC | 3364 | GCCGCAGGGGAGUGCAGAC |
| 1096 | 2784 | UCUGCACUCCCCUGCGGCC | 3365 | GGCCGCAGGGGAGUGCAGA |
| 1097 | 2785 | CUGCACUCCCCUGCGGCCU | 3366 | AGGCCGCAGGGGAGUGCAG |
| 1098 | 2786 | UGCACUCCCCUGCGGCCUG | 3367 | CAGGCCGCAGGGGAGUGCA |
| 1100 | 2787 | CACUCCCCUGCGGCCUGCU | 3368 | AGCAGGCCGCAGGGGAGUG |
| 1101 | 2788 | ACUCCCCUGCGGCCUGCUG | 3369 | CAGCAGGCCGCAGGGGAGU |
| 1103 | 2789 | UCCCCUGCGGCCUGCUGCU | 976 | AGCAGCAGGCCGCAGGGGA |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 1106 | 2790 | CCUGCGGCCUGCUGCUGGA | 3370 | UCCAGCAGCAGGCCGCAGG |
| 1107 | 2791 | CUGCGGCCUGCUGCUGGAU | 3371 | AUCCAGCAGCAGGCCGCAG |
| 1108 | 2792 | UGCGGCCUGCUGCUGGAUG | 3372 | CAUCCAGCAGCAGGCCGCA |
| 1109 | 2793 | GCGGCCUGCUGCUGGAUGA | 3373 | UCAUCCAGCAGCAGGCCGC |
| 1110 | 2794 | CGGCCUGCUGCUGGAUGAG | 3374 | CUCAUCCAGCAGCAGGCCG |
| 1111 | 2795 | GGCCUGCUGCUGGAUGAGC | 3375 | GCUCAUCCAGCAGCAGGCC |
| 1112 | 2796 | GCCUGCUGCUGGAUGAGCU | 3376 | AGCUCAUCCAGCAGCAGGC |
| 1113 | 2797 | CCUGCUGCUGGAUGAGCUC | 3377 | GAGCUCAUCCAGCAGCAGG |
| 1114 | 2798 | CUGCUGCUGGAUGAGCUCC | 3378 | GGAGCUCAUCCAGCAGCAG |
| 1115 | 2799 | UGCUGCUGGAUGAGCUCCU | 3379 | AGGAGCUCAUCCAGCAGCA |
| 1116 | 2800 | GCUGCUGGAUGAGCUCCUG | 3380 | CAGGAGCUCAUCCAGCAGC |
| 1117 | 2801 | CUGCUGGAUGAGCUCCUGG | 3381 | CCAGGAGCUCAUCCAGCAG |
| 1118 | 2802 | UGCUGGAUGAGCUCCUGGC | 3382 | GCCAGGAGCUCAUCCAGCA |
| 1119 | 2803 | GCUGGAUGAGCUCCUGGCG | 3383 | CGCCAGGAGCUCAUCCAGC |
| 1130 | 2804 | UCCUGGCGAGCCCGGAGUU | 3384 | AACUCCGGGCUCGCCAGGA |
| 1131 | 2805 | CCUGGCGAGCCCGGAGUUU | 3385 | AAACUCCGGGCUCGCCAGG |
| 1132 | 2806 | CUGGCGAGCCCGGAGUUUC | 3386 | GAAACUCCGGGCUCGCCAG |
| 1137 | 2807 | GAGCCCGGAGUUUCUGCAG | 3387 | CUGCAGAAACUCCGGGCUC |
| 1138 | 2808 | AGCCCGGAGUUUCUGCAGC | 3388 | GCUGCAGAAACUCCGGGCU |
| 1139 | 2809 | GCCCGGAGUUUCUGCAGCA | 3389 | UGCUGCAGAAACUCCGGGC |
| 1140 | 2810 | CCCGGAGUUUCUGCAGCAG | 3390 | CUGCUGCAGAAACUCCGGG |
| 1141 | 2811 | CCGGAGUUUCUGCAGCAGG | 3391 | CCUGCUGCAGAAACUCCGG |
| 1142 | 2812 | CGGAGUUUCUGCAGCAGGC | 3392 | GCCUGCUGCAGAAACUCCG |
| 1143 | 2813 | GGAGUUUCUGCAGCAGGCG | 3393 | CGCCUGCUGCAGAAACUCC |
| 1144 | 2814 | GAGUUUCUGCAGCAGGCGC | 3394 | GCGCCUGCUGCAGAAACUC |
| 1145 | 2815 | AGUUUCUGCAGCAGGCGCA | 3395 | UGCGCCUGCUGCAGAAACU |
| 1146 | 2816 | GUUUCUGCAGCAGGCGCAA | 3396 | UUGCGCCUGCUGCAGAAAC |
| 1147 | 2817 | UUUCUGCAGCAGGCGCAAC | 3397 | GUUGCGCCUGCUGCAGAAA |
| 1148 | 2818 | UUCUGCAGCAGGCGCAACC | 3398 | GGUUGCGCCUGCUGCAGAA |
| 1149 | 2819 | UCUGCAGCAGGCGCAACCU | 3399 | AGGUUGCGCCUGCUGCAGA |
| 1150 | 2820 | CUGCAGCAGGCGCAACCUC | 3400 | GAGGUUGCGCCUGCUGCAG |
| 1151 | 2821 | UGCAGCAGGCGCAACCUCU | 3401 | AGAGGUUGCGCCUGCUGCA |
| 1152 | 2822 | GCAGCAGGCGCAACCUCUC | 3402 | GAGAGGUUGCGCCUGCUGC |
| 1153 | 2823 | CAGCAGGCGCAACCUCUCC | 3403 | GGAGAGGUUGCGCCUGCUG |
| 1154 | 2824 | AGCAGGCGCAACCUCUCCU | 3404 | AGGAGAGGUUGCGCCUGCU |
| 1155 | 2825 | GCAGGCGCAACCUCUCCUA | 3405 | UAGGAGAGGUUGCGCCUGC |
| 1156 | 2826 | CAGGCGCAACCUCUCCUAG | 3406 | CUAGGAGAGGUUGCGCCUG |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 1157 | 2827 | AGGCGCAACCUCUCCUAGA | 3407 | UCUAGGAGAGGUUGCGCCU |
| 1158 | 2828 | GGCGCAACCUCUCCUAGAA | 3408 | UUCUAGGAGAGGUUGCGCC |
| 1159 | 2829 | GCGCAACCUCUCCUAGAAA | 3409 | UUUCUAGGAGAGGUUGCGC |
| 1160 | 2830 | CGCAACCUCUCCUAGAAAC | 3410 | GUUUCUAGGAGAGGUUGCG |
| 1161 | 2831 | GCAACCUCUCCUAGAAACG | 3411 | CGUUUCUAGGAGAGGUUGC |
| 1162 | 2832 | CAACCUCUCCUAGAAACGG | 3412 | CCGUUUCUAGGAGAGGUUG |
| 1163 | 2833 | AACCUCUCCUAGAAACGGA | 3413 | UCCGUUUCUAGGAGAGGUU |
| 1169 | 2834 | UCCUAGAAACGGAGGCCCC | 3414 | GGGGCCUCCGUUUCUAGGA |
| 1170 | 2835 | CCUAGAAACGGAGGCCCCG | 3415 | CGGGGCCUCCGUUUCUAGG |
| 1171 | 2836 | CUAGAAACGGAGGCCCCGG | 3416 | CCGGGGCCUCCGUUUCUAG |
| 1428 | 2837 | CCGGUGAGAGACUCCACUC | 3417 | GAGUGGAGUCUCUCACCGG |
| 1429 | 2838 | CGGUGAGAGACUCCACUCC | 3418 | GGAGUGGAGUCUCUCACCG |
| 1430 | 2839 | GGUGAGAGACUCCACUCCG | 3419 | CGGAGUGGAGUCUCUCACC |
| 1570 | 2840 | CCCUUGUUCUUCCGUGAAA | 3420 | UUUCACGGAAGAACAAGGG |
| 1571 | 2841 | CCUUGUUCUUCCGUGAAAU | 3421 | AUUUCACGGAAGAACAAGG |
| 1572 | 2842 | CUUGUUCUUCCGUGAAAUU | 3422 | AAUUUCACGGAAGAACAAG |
| 1573 | 2843 | UUGUUCUUCCGUGAAAUUC | 3423 | GAAUUUCACGGAAGAACAA |
| 1574 | 2844 | UGUUCUUCCGUGAAAUUCU | 3424 | AGAAUUUCACGGAAGAACA |
| 1575 | 2845 | GUUCUUCCGUGAAAUUCUG | 3425 | CAGAAUUUCACGGAAGAAC |
| 1576 | 2846 | UUCUUCCGUGAAAUUCUGG | 3426 | CCAGAAUUUCACGGAAGAA |
| 1577 | 2847 | UCUUCCGUGAAAUUCUGGC | 3427 | GCCAGAAUUUCACGGAAGA |
| 1578 | 2848 | CUUCCGUGAAAUUCUGGCU | 3428 | AGCCAGAAUUUCACGGAAG |
| 1589 | 2849 | UUCUGGCUGAAUGUCUCCC | 3429 | GGGAGACAUUCAGCCAGAA |
| 1590 | 2850 | UCUGGCUGAAUGUCUCCCC | 3430 | GGGGAGACAUUCAGCCAGA |
| 1618 | 2851 | GACGCUGUCUAGGCAAACC | 3431 | GGUUUGCCUAGACAGCGUC |
| 1619 | 2852 | ACGCUGUCUAGGCAAACCU | 3432 | AGGUUUGCCUAGACAGCGU |
| 1620 | 2853 | CGCUGUCUAGGCAAACCUG | 3433 | CAGGUUUGCCUAGACAGCG |
| 1621 | 2854 | GCUGUCUAGGCAAACCUGG | 3434 | CCAGGUUUGCCUAGACAGC |
| 1622 | 2855 | CUGUCUAGGCAAACCUGGA | 3435 | UCCAGGUUUGCCUAGACAG |
| 1623 | 2856 | UGUCUAGGCAAACCUGGAU | 3436 | AUCCAGGUUUGCCUAGACA |
| 1624 | 2857 | GUCUAGGCAAACCUGGAUU | 3437 | AAUCCAGGUUUGCCUAGAC |
| 1625 | 2858 | UCUAGGCAAACCUGGAUUA | 3438 | UAAUCCAGGUUUGCCUAGA |
| 1626 | 2859 | CUAGGCAAACCUGGAUUAG | 3439 | CUAAUCCAGGUUUGCCUAG |
| 1627 | 2860 | UAGGCAAACCUGGAUUAGA | 3440 | UCUAAUCCAGGUUUGCCUA |
| 1628 | 2861 | AGGCAAACCUGGAUUAGAG | 3441 | CUCUAAUCCAGGUUUGCCU |
| 1629 | 2862 | GGCAAACCUGGAUUAGAGU | 3442 | ACUCUAAUCCAGGUUUGCC |
| 1630 | 2863 | GCAAACCUGGAUUAGAGUU | 3443 | AACUCUAAUCCAGGUUUGC |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 1631 | 2864 | CAAACCUGGAUUAGAGUUA | 3444 | UAACUCUAAUCCAGGUUUG |
| 1632 | 2865 | AAACCUGGAUUAGAGUUAC | 3445 | GUAACUCUAAUCCAGGUUU |
| 1633 | 2866 | AACCUGGAUUAGAGUUACA | 3446 | UGUAACUCUAAUCCAGGUU |
| 1634 | 2867 | ACCUGGAUUAGAGUUACAU | 3447 | AUGUAACUCUAAUCCAGGU |
| 1635 | 2868 | CCUGGAUUAGAGUUACAUC | 3448 | GAUGUAACUCUAAUCCAGG |
| 1636 | 2869 | CUGGAUUAGAGUUACAUCU | 3449 | AGAUGUAACUCUAAUCCAG |
| 1637 | 2870 | UGGAUUAGAGUUACAUCUC | 3450 | GAGAUGUAACUCUAAUCCA |
| 1638 | 2871 | GGAUUAGAGUUACAUCUCC | 3451 | GGAGAUGUAACUCUAAUCC |
| 1639 | 2872 | GAUUAGAGUUACAUCUCCU | 3452 | AGGAGAUGUAACUCUAAUC |
| 1640 | 2873 | AUUAGAGUUACAUCUCCUG | 3453 | CAGGAGAUGUAACUCUAAU |
| 1641 | 2874 | UUAGAGUUACAUCUCCUGG | 3454 | CCAGGAGAUGUAACUCUAA |
| 1642 | 2875 | UAGAGUUACAUCUCCUGGA | 3455 | UCCAGGAGAUGUAACUCUA |
| 1643 | 2876 | AGAGUUACAUCUCCUGGAU | 3456 | AUCCAGGAGAUGUAACUCU |
| 1651 | 2877 | AUCUCCUGGAUGAUUAGUU | 3457 | AACUAAUCAUCCAGGAGAU |
| 1652 | 2878 | UCUCCUGGAUGAUUAGUUC | 3458 | GAACUAAUCAUCCAGGAGA |
| 1653 | 2879 | CUCCUGGAUGAUUAGUUCA | 3459 | UGAACUAAUCAUCCAGGAG |
| 1654 | 2880 | UCCUGGAUGAUUAGUUCAG | 3460 | CUGAACUAAUCAUCCAGGA |
| 1655 | 2881 | CCUGGAUGAUUAGUUCAGA | 3461 | UCUGAACUAAUCAUCCAGG |
| 1656 | 2882 | CUGGAUGAUUAGUUCAGAG | 3462 | CUCUGAACUAAUCAUCCAG |
| 26 | 2883 | GCACCCUCCCCGCGGAAGC | 3463 | GCUUCCGCGGGGAGGGUGC |
| 27 | 2884 | CACCCUCCCCGCGGAAGCC | 3464 | GGCUUCCGCGGGGAGGGUG |
| 28 | 2885 | ACCCUCCCCGCGGAAGCCC | 3465 | GGGCUUCCGCGGGGAGGGU |
| 30 | 2886 | CCUCCCCGCGGAAGCCCGG | 3466 | CCGGGCUUCCGCGGGGAGG |
| 35 | 468 | CCGCGGAAGCCCGGGGACG | 3467 | CGUCCCCGGGCUUCCGCGG |
| 37 | 469 | GCGGAAGCCCGGGGACGAG | 3468 | CUCGUCCCCGGGCUUCCGC |
| 38 | 470 | CGGAAGCCCGGGGACGAGG | 3469 | CCUCGUCCCCGGGCUUCCG |
| 193 | 2887 | AUUUGGUUUCAGAAUGAGA | 3470 | UCUCAUUCUGAAACCAAAU |
| 233 | 2888 | ACCGGCGGGAAUCUCGGCC | 3471 | GGCCGAGAUUCCCGCCGGU |
| 250 | 2889 | CCCUGGCCCGGGAGACGCG | 3472 | CGCGUCUCCCGGGCCAGGG |
| 251 | 2890 | CCUGGCCCGGGAGACGCGG | 3473 | CCGCGUCUCCCGGGCCAGG |
| 252 | 2891 | CUGGCCCGGGAGACGCGGC | 3474 | GCCGCGUCUCCCGGGCCAG |
| 263 | 476 | GACGCGGCCCGCCAGAAGG | 3475 | CCUUCUGGCGGGCCGCGUC |
| 264 | 477 | ACGCGGCCCGCCAGAAGGC | 3476 | GCCUUCUGGCGGGCCGCGU |
| 279 | 478 | AGGCCGGCGAAAGCGGACC | 3477 | GGUCCGCUUUCGCCGGCCU |
| 280 | 479 | GGCCGGCGAAAGCGGACCG | 3478 | CGGUCCGCUUUCGCCGGCC |
| 281 | 480 | GCCGGCGAAAGCGGACCGC | 3479 | GCGGUCCGCUUUCGCCGGC |
| 317 | 2892 | CCGCCCUGCUCCUCCGAGC | 3480 | GCUCGGAGGAGCAGGGCGG |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 355 | 2893 | CCAGGCAUCGCCGCCCGGG | 3481 | CCCGGGCGGCGAUGCCUGG |
| 359 | 2894 | GCAUCGCCGCCCGGGAGGA | 3482 | UCCUCCCGGGCGGCGAUGC |
| 360 | 2895 | CAUCGCCGCCCGGGAGGAG | 3483 | CUCCUCCCGGGGGCGAUG |
| 361 | 2896 | AUCGCCGCCCGGGAGGAGC | 3484 | GCUCCUCCCGGGCGGCGAU |
| 362 | 2897 | UCGCCGCCCGGGAGGAGCU | 3485 | AGCUCCUCCCGGGCGGCGA |
| 363 | 2898 | CGCCGCCCGGGAGGAGCUG | 3486 | CAGCUCCUCCCGGGCGGCG |
| 437 | 488 | GGGCCAGGCACCCGGGACA | 3487 | UGUCCCGGGUGCCUGGCCC |
| 452 | 2899 | GACAGGGUGGCAGGGCGCC | 3488 | GGCGCCCUGCCACCCUGUC |
| 453 | 2900 | ACAGGGUGGCAGGGCGCCC | 3489 | GGGCGCCCUGCCACCCUGU |
| 455 | 2901 | AGGGUGGCAGGGCGCCCGC | 3490 | GCGGGCGCCCUGCCACCCU |
| 456 | 2902 | GGGUGGCAGGGCGCCCGCG | 3491 | CGCGGGCGCCCUGCCACCC |
| 458 | 2903 | GUGGCAGGGCGCCCGCGCA | 3492 | UGCGCGGGCGCCCUGCCAC |
| 480 | 2904 | AGGCGGCCUGUGCAGCGCG | 3493 | CGCGCUGCACAGGCCGCCU |
| 481 | 2905 | GGCGGCCUGUGCAGCGCGG | 3494 | CCGCGCUGCACAGGCCGCC |
| 482 | 2906 | GCGGCCUGUGCAGCGCGGC | 3495 | GCCGCGCUGCACAGGCCGC |
| 534 | 2907 | CGCCUUCGCCCACACCGGC | 3496 | GCCGGUGUGGGCGAAGGCG |
| 546 | 2908 | CACCGGCGCGUGGGGAACG | 3497 | CGUUCCCCACGCGCCGGUG |
| 547 | 2909 | ACCGGCGCGUGGGGAACGG | 3498 | CCGUUCCCCACGCGCCGGU |
| 548 | 2910 | CCGGCGCGUGGGGAACGGG | 3499 | CCCGUUCCCCACGCGCCGG |
| 549 | 2911 | CGGCGCGUGGGGAACGGGG | 3500 | CCCCGUUCCCCACGCGCCG |
| 551 | 2912 | GCGCGUGGGGAACGGGGCU | 3501 | AGCCCCGUUCCCCACGCGC |
| 565 | 2913 | GGGCUUCCCGCACCCCACG | 3502 | CGUGGGGUGCGGGAAGCCC |
| 575 | 2914 | CACCCCACGUGCCCUGCGC | 3503 | GCGCAGGGCACGUGGGGUG |
| 577 | 2915 | CCCCACGUGCCCUGCGCGC | 3504 | GCGCGCAGGGCACGUGGGG |
| 579 | 2916 | CCACGUGCCCUGCGCGCCU | 3505 | AGGCGCGCAGGGCACGUGG |
| 581 | 2917 | ACGUGCCCUGCGCGCCUGG | 3506 | CCAGGCGCGCAGGGCACGU |
| 588 | 2918 | CUGCGCGCCUGGGGCUCUC | 1114 | GAGAGCCCCAGGCGCGCAG |
| 616 | 2919 | GCUUUCGUGAGCCAGGCAG | 3507 | CUGCCUGGCUCACGAAAGC |
| 617 | 2920 | CUUUCGUGAGCCAGGCAGC | 3508 | GCUGCCUGGCUCACGAAAG |
| 618 | 2921 | UUUCGUGAGCCAGGCAGCG | 3509 | CGCUGCCUGGCUCACGAAA |
| 627 | 512 | CCAGGCAGCGAGGGCCGCC | 3510 | GGCGGCCCUCGCUGCCUGG |
| 652 | 2922 | CUGCAGCCCAGCCAGGCCG | 3511 | CGGCCUGGCUGGGCUGCAG |
| 654 | 514 | GCAGCCCAGCCAGGCCGCG | 3512 | CGCGGCCUGGCUGGGCUGC |
| 659 | 515 | CCAGCCAGGCCGCGCCGGC | 3513 | GCCGGCGCGGCCUGGCUGG |
| 668 | 2923 | CCGCGCCGGCAGAGGGGAU | 3514 | AUCCCCUCUGCCGGCGCGG |
| 690 | 2924 | CCAACCUGCCCCGGCGCGC | 3515 | GCGCGCCGGGGCAGGUUGG |
| 692 | 2925 | AACCUGCCCCGGCGCGCGG | 3516 | CCGCGCGCCGGGGCAGGUU |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 705 | 2926 | GCGCGGGGAUUUCGCCUAC | 3517 | GUAGGCGAAAUCCCCGCGC |
| 715 | 2927 | UUCGCCUACGCCGCCCCGG | 3518 | CCGGGGCGGCGUAGGCGAA |
| 717 | 2928 | CGCCUACGCCGCCCCGGCU | 3519 | AGCCGGGGCGGCGUAGGCG |
| 732 | 2929 | GGCUCCUCCGGACGGGGCG | 3520 | CGCCCCGUCCGGAGGAGCC |
| 733 | 2930 | GCUCCUCCGGACGGGGCGC | 3521 | GCGCCCCGUCCGGAGGAGC |
| 745 | 2931 | GGGGCGCUCUCCCACCCUC | 3522 | GAGGGUGGGAGAGCGCCCC |
| 802 | 525 | GAGGACCGGGACCCGCAGC | 3523 | GCUGCGGGUCCCGGUCCUC |
| 809 | 526 | GGGACCCGCAGCGCGACGG | 3524 | CCGUCGCGCUGCGGGUCCC |
| 813 | 2932 | CCCGCAGCGCGACGGCCUG | 3525 | CAGGCCGUCGCGCUGCGGG |
| 827 | 2933 | GCCUGCCGGGCCCCUGCGC | 1134 | GCGCAGGGGCCCGGCAGGC |
| 839 | 2934 | CCUGCGCGGUGGCACAGCC | 3526 | GGCUGUGCCACCGCGCAGG |
| 842 | 2935 | GCGCGGUGGCACAGCCUGG | 3527 | CCAGGCUGUGCCACCGCGC |
| 843 | 2936 | CGCGGUGGCACAGCCUGGG | 3528 | CCCAGGCUGUGCCACCGCG |
| 845 | 2937 | CGGUGGCACAGCCUGGGCC | 3529 | GGCCCAGGCUGUGCCACCG |
| 850 | 2938 | GCACAGCCUGGGCCCGCUC | 3530 | GAGCGGGCCCAGGCUGUGC |
| 856 | 2939 | CCUGGGCCCGCUCAAGCGG | 3531 | CCGCUUGAGCGGGCCCAGG |
| 877 | 2940 | CCGCAGGGCCAAGGGGUGC | 3532 | GCACCCCUUGGCCCUGCGG |
| 892 | 2941 | GUGCUUGCGCCACCCACGU | 3533 | ACGUGGGUGGCGCAAGCAC |
| 893 | 2942 | UGCUUGCGCCACCCACGUC | 3534 | GACGUGGGUGGCGCAAGCA |
| 894 | 2943 | GCUUGCGCCACCCACGUCC | 3535 | GGACGUGGGUGGCGCAAGC |
| 895 | 2944 | CUUGCGCCACCCACGUCCC | 3536 | GGGACGUGGGUGGCGCAAG |
| 897 | 2945 | UGCGCCACCCACGUCCCAG | 3537 | CUGGGACGUGGGUGGCGCA |
| 919 | 2946 | AGUCCGUGGUGGGGCUGGG | 3538 | CCCAGCCCCACCACGGACU |
| 936 | 2947 | GGGCCGGGGUCCCCAGGUC | 3539 | GACCUGGGGACCCCGGCCC |
| 939 | 2948 | CCGGGGUCCCCAGGUCGCC | 3540 | GGCGACCUGGGGACCCCGG |
| 956 | 2949 | CCGGGGCGGCGUGGGAACC | 3541 | GGUUCCCACGCCGCCCCGG |
| 989 | 2950 | CUCCACCUCCCCAGCCCGC | 3542 | GCGGGCUGGGGAGGUGGAG |
| 992 | 2951 | CACCUCCCCAGCCCGCGCC | 3543 | GGCGCGGGCUGGGGAGGUG |
| 994 | 2952 | CCUCCCCAGCCCGCGCCCC | 3544 | GGGGCGCGGGCUGGGGAGG |
| 1023 | 2953 | CGCCUCCGCGCGGCAGGGG | 3545 | CCCCUGCCGCGCGGAGGCG |
| 1028 | 2954 | CCGCGCGGCAGGGGCAGAU | 3546 | AUCUGCCCCUGCCGCGCGG |
| 1030 | 2955 | GCGCGGCAGGGGCAGAUGC | 3547 | GCAUCUGCCCCUGCCGCGC |
| 1067 | 2956 | CCCAGGCGCUCCAGGAGCC | 3548 | GGCUCCUGGAGCGCCUGGG |
| 1081 | 2957 | GAGCCGGCGCCCUGGUCUG | 3549 | CAGACCAGGGCGCCGGCUC |
| 1083 | 2958 | GCCGGCGCCCUGGUCUGCA | 3550 | UGCAGACCAGGGCGCCGGC |
| 1084 | 2959 | CCGGCGCCCUGGUCUGCAC | 3551 | GUGCAGACCAGGGCGCCGG |
| 1085 | 2960 | CGGCGCCCUGGUCUGCACU | 3552 | AGUGCAGACCAGGGCGCCG |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 1102 | 2961 | CUCCCCUGCGGCCUGCUGC | 1162 | GCAGCAGGCCGCAGGGGAG |
| 1120 | 2962 | CUGGAUGAGCUCCUGGCGA | 3553 | UCGCCAGGAGCUCAUCCAG |
| 1189 | 2963 | GGGGAGCUGGAGGCCUCGG | 3554 | CCGAGGCCUCCAGCUCCCC |
| 1192 | 2964 | GAGCUGGAGGCCUCGGAAG | 3555 | CUUCCGAGGCCUCCAGCUC |
| 1193 | 2965 | AGCUGGAGGCCUCGGAAGA | 3556 | UCUUCCGAGGCCUCCAGCU |
| 1194 | 2966 | GCUGGAGGCCUCGGAAGAG | 3557 | CUCUUCCGAGGCCUCCAGC |
| 1212 | 2967 | GGCCGCCUCGCUGGAAGCA | 3558 | UGCUUCCAGCGAGGCGGCC |
| 1213 | 2968 | GCCGCCUCGCUGGAAGCAC | 3559 | GUGCUUCCAGCGAGGCGGC |
| 1214 | 2969 | CCGCCUCGCUGGAAGCACC | 3560 | GGUGCUUCCAGCGAGGCGG |
| 1215 | 2970 | CGCCUCGCUGGAAGCACCC | 3561 | GGGUGCUUCCAGCGAGGCG |
| 1216 | 2971 | GCCUCGCUGGAAGCACCCC | 3562 | GGGGUGCUUCCAGCGAGGC |
| 1218 | 2972 | CUCGCUGGAAGCACCCCUC | 3563 | GAGGGGUGCUUCCAGCGAG |
| 1234 | 2973 | CUCAGCGAGGAAGAAUACC | 3564 | GGUAUUCUUCCUCGCUGAG |
| 1235 | 2974 | UCAGCGAGGAAGAAUACCG | 3565 | CGGUAUUCUUCCUCGCUGA |
| 1242 | 2975 | GGAAGAAUACCGGGCUCUG | 3566 | CAGAGCCCGGUAUUCUUCC |
| 1251 | 2976 | CCGGGCUCUGCUGGAGGAG | 3567 | CUCCUCCAGCAGAGCCCGG |
| 1257 | 2977 | UCUGCUGGAGGAGCUUUAG | 3568 | CUAAAGCUCCUCCAGCAGA |
| 1258 | 2978 | CUGCUGGAGGAGCUUUAGG | 3569 | CCUAAAGCUCCUCCAGCAG |
| 1260 | 2979 | GCUGGAGGAGCUUUAGGAC | 3570 | GUCCUAAAGCUCCUCCAGC |
| 1261 | 2980 | CUGGAGGAGCUUUAGGACG | 3571 | CGUCCUAAAGCUCCUCCAG |
| 1265 | 2981 | AGGAGCUUUAGGACGCGGG | 3572 | CCCGCGUCCUAAAGCUCCU |
| 1266 | 2982 | GGAGCUUUAGGACGCGGGG | 3573 | CCCCGCGUCCUAAAGCUCC |
| 1267 | 2983 | GAGCUUUAGGACGCGGGGU | 3574 | ACCCCGCGUCCUAAAGCUC |
| 1268 | 2984 | AGCUUUAGGACGCGGGGUU | 3575 | AACCCCGCGUCCUAAAGCU |
| 1269 | 2985 | GCUUUAGGACGCGGGGUUG | 3576 | CAACCCCGCGUCCUAAAGC |
| 1270 | 2986 | CUUUAGGACGCGGGGUUGG | 3577 | CCAACCCCGCGUCCUAAAG |
| 1271 | 2987 | UUUAGGACGCGGGGUUGGG | 3578 | CCCAACCCCGCGUCCUAAA |
| 1272 | 2988 | UUAGGACGCGGGGUUGGGA | 3579 | UCCCAACCCCGCGUCCUAA |
| 1274 | 2989 | AGGACGCGGGGUUGGGACG | 3580 | CGUCCCAACCCCGCGUCCU |
| 1279 | 2990 | GCGGGGUUGGGACGGGGUC | 3581 | GACCCCGUCCCAACCCCGC |
| 1284 | 2991 | GUUGGGACGGGGUCGGGUG | 3582 | CACCCGACCCCGUCCCAAC |
| 1288 | 2992 | GGACGGGGUCGGGUGGUUC | 3583 | GAACCACCCGACCCCGUCC |
| 1389 | 2993 | GGCUGACCGGCCUGGGAUU | 3584 | AAUCCCAGGCCGGUCAGCC |
| 1390 | 2994 | GCUGACCGGCCUGGGAUUC | 3585 | GAAUCCCAGGCCGGUCAGC |
| 1400 | 2995 | CUGGGAUUCCUGCCUUCUA | 3586 | UAGAAGGCAGGAAUCCCAG |
| 1401 | 2996 | UGGGAUUCCUGCCUUCUAG | 3587 | CUAGAAGGCAGGAAUCCCA |
| 1419 | 2997 | GGUCUAGGCCCGGUGAGAG | 3588 | CUCUCACCGGGCCUAGACC |

TABLE 1F-continued provides exemplary unmodified siRNAs with the sequences of the sense strand and the antisense strand.

| Position in transcript | SEQ ID NO: | Sense strand | SEQ ID NO: | Antisense strand |
|---|---|---|---|---|
| 1420 | 2998 | GUCUAGGCCCGGUGAGAGA | 3589 | UCUCUCACCGGGCCUAGAC |
| 1421 | 2999 | UCUAGGCCCGGUGAGAGAC | 3590 | GUCUCUCACCGGGCCUAGA |
| 1422 | 3000 | CUAGGCCCGGUGAGAGACU | 3591 | AGUCUCUCACCGGGCCUAG |
| 1425 | 3001 | GGCCCGGUGAGAGACUCCA | 3592 | UGGAGUCUCUCACCGGGCC |
| 1426 | 3002 | GCCCGGUGAGAGACUCCAC | 3593 | GUGGAGUCUCUCACCGGGC |
| 1427 | 3003 | CCCGGUGAGAGACUCCACU | 3594 | AGUGGAGUCUCUCACCGGG |
| 1607 | 3004 | CCCCACCUUCCGACGCUGU | 3595 | ACAGCGUCGGAAGGUGGGG |
| 1608 | 3005 | CCCACCUUCCGACGCUGUC | 3596 | GACAGCGUCGGAAGGUGGG |
| 1612 | 3006 | CCUUCCGACGCUGUCUAGG | 3597 | CCUAGACAGCGUCGGAAGG |
| 1613 | 3007 | CUUCCGACGCUGUCUAGGC | 3598 | GCCUAGACAGCGUCGGAAG |
| 1614 | 3008 | UUCCGACGCUGUCUAGGCA | 3599 | UGCCUAGACAGCGUCGGAA |
| 1615 | 3009 | UCCGACGCUGUCUAGGCAA | 3600 | UUGCCUAGACAGCGUCGGA |
| 1616 | 3010 | CCGACGCUGUCUAGGCAAA | 3601 | UUUGCCUAGACAGCGUCGG |
| 1617 | 3011 | CGACGCUGUCUAGGCAAAC | 3602 | GUUUGCCUAGACAGCGUCG |

Column 1 shows the beginning position of the target sequence in DUX4_human_#NM_001306068.3 (SEQ ID NO: 2425).
The target sequence is 19 nucleotide long starting from the beginning position.
For example, row 1 shows that the beginning position of the target sequence is 1, which means that the target sequence is the sequence corresponding to positions 1-19 of DUX4_human_#NM_001306068.3 (SEQ ID NO: 2425).
As the nucleotide "T" in the unmodified siRNAs in Table 1A represents RNA uridine, the siRNAs in Table 1F may be used interchangeably with the siRNAs in Table 1A targeting the same positions.
The sequences of the sense strands and antisense strands are shown from the 5' end to the 3' end.

TABLE 2

List of abbreviations of nucleotides in the nucleic acid sequences disclosed herein, e.g., in Tables 1B-1E

| Abbreviation | Nucleotide(s) |
|---|---|
| A | adenosine-3'-phosphate |
| Af | 2'-deoxy-2'-fluoro-adenosine-3'-phosphate |
| Afs | 2'-deoxy-2'-fluoro-adenosine-3'-phosphorothioate |
| As | adenosine-3'-phosphorothioate |
| C | cytidine-3'-phosphate |
| Cf | 2'-deoxy-2'-fluoro-cytidine-3'-phosphate |
| Cfs | 2'-deoxy-2'-fluoro-cytidine-3'-phosphorothioate |
| Cs | cytidine-3'-phosphorothioate |
| G | Guanosine-3'-phosphate |
| Gf | 2'-deoxy-2'-fluoro-guanosine-3'-phosphate |
| Gfs | 2'-deoxy-2'-fluoro-guanosine-3'-phosphorothioate |
| Gs | guanosine-3'-phosphorothioate |
| U | uridine-3'-phosphate |
| Uf | 2'-deoxy-2'-fluoro-uridine-3'-phosphate |

TABLE 2-continued

List of abbreviations of nucleotides in the nucleic acid sequences disclosed herein, e.g., in Tables 1B-1E

| Abbreviation | Nucleotide(s) |
|---|---|
| Ufs | 2'-deoxy-2'-fluoro-uridine-3'-phosphorothioate |
| Us | uridine-3'-phosphorothioate |
| a | 2'-O-methyl-adenosine-3'-phosphate |
| as | 2'-O-methyl-adenosine-3'-phosphorothioate |
| c | 2'-O-methyl-cytidine-3'-phosphate |
| cs | 2'-O-methyl-cytidine-3'-phosphorothioate |
| g | 2'-O-methyl-guanosine-3'-phosphate |
| gs | 2'-O-methyl-guanosine-3'-phosphorothioate |
| u | 2'-O-methyl-uridine-3'-phosphate |
| us | 2'-O-methyl-uridine-3'-phosphorothioate |
| T | deoxythymidine-3'-phosphate |
| vpUs | 5'-vinylphosphonate-2'-O-methyl-uridine-3'-phosphorothioate |

TABLE 3

Exemplary sequences of DUX4 mRNA transcript

| SEQ ID NO | Sequence |
|---|---|
| 2425 | NM_001306068.3 *Homo sapiens* double homeobox 4 (DUX4), transcript variant 1, mRNA:<br>ATGGCCCTCCCGACACCCTCGGACAGCACCCTCCCCGCGGAAGCCCGGGGACGAGG<br>ACGGCGACGGAGACTCGTTTGGACCCCGAGCCAAAGCGAGGCCCTGCGAGCCTGCT<br>TTGAGCGGAACCCGTACCCGGGCATCGCCACCAGAGAACGGCTGGCCCAGGCCATC<br>GGCATTCCGGAGCCCAGGGTCCAGATTTGGTTTCAGAATGAGAGGTCACGCCAGCTG |

TABLE 3-continued

Exemplary sequences of DUX4 mRNA transcript

| SEQ ID NO | Sequence |
|---|---|
| | AGGCAGCACCGGCGGGAATCTCGGCCCTGGCCCGGGAGACGCGGCCCGCCAGAAG<br>GCCGGCGAAAGCGGACCGCCGTCACCGGATCCCAGACCGCCCTGCTCCTCCGAGCC<br>TTTGAGAAGGATCGCTTTCCAGGCATCGCCGCCCGGGAGGAGCTGGCCAGAGAGAC<br>GGGCCTCCCGGAGTCCAGGATTCAGATCTGGTTTCAGAATCGAAGGGCCAGGCACCC<br>GGGACAGGGTGGCAGGGCGCCCGCGCAGGCAGGCGGCCTGTGCAGCGCGGCCCC<br>CGGCGGGGGTCACCCTGCTCCCTCGTGGGTCGCCTTCGCCCACACCGGCGCGTGGG<br>GAACGGGGCTTCCCGCACCCCACGTGCCCTGCGCGCCTGGGGCTCTCCCACAGGGG<br>GCTTTCGTGAGCCAGGCAGCGAGGGCCGCCCCCGCGCTGCAGCCCAGCCAGGCCG<br>CGCCGGCAGAGGGGATCTCCCAACCTGCCCCGGCGCGCGGGGATTTCGCCTACGCC<br>GCCCCGGCTCCTCCGGACGGGGCGCTCTCCCACCCTCAGGCTCCTCGGTGGCCTCC<br>GCACCCGGGCAAAAGCCGGGAGGACCGGGACCCGCAGCGCGACGGCCTGCCGGGC<br>CCCTGCGCGGTGGCACAGCCTGGGCCCGCTCAAGCGGGGCCGCAGGGCCAAGGGG<br>TGCTTGCGCCACCCACGTCCCAGGGGAGTCCGTGGTGGGGCTGGGGCCGGGGTCC<br>CCAGGTCGCCGGGGGGCGTGGGAACCCCAAGCCGGGGCAGCTCCACCTCCCCAG<br>CCCGCGCCCCCGGACGCCTCCGCCTCCGCGCGGCAGGGGCAGATGCAAGGCATCC<br>CGGCGCCCTCCCAGGCGCTCCAGGAGCCGGCGCCCTGGTCTGCACTCCCCTGCGGC<br>CTGCTGCTGGATGAGCTCCTGGCGAGCCCGGAGTTTCTGCAGCAGGCGCAACCTCTC<br>CTAGAAACGGAGGCCCCGGGGGAGCTGGAGGCCTCGGAAGAGGCCGCCTCGCTGG<br>AAGCACCCCTCAGCGAGGAAGAATACCGGGCTCTGCTGGAGGAGCTTTAGGACGCG<br>GGGTTGGGACGGGGTCGGGTGGTTCGGGGCAGGGCGGTGGCCTCTCTTTCGCGGG<br>GAACACCTGGCTGGCTACGGAGGGGCGTGTCTCCGCCCCGCCCCCTCCACCGGGCT<br>GACCGGCCTGGGATTCCTGCCTTCTAGGTCTAGGCCCGGTGAGAGACTCCACTCCGC<br>GGAGAACTGCCTTTCTTTCCTGGGCATCCCGGGGATCCCAGAGCCGGCCCAGGTACC<br>AGCAGACCTGCGCGCAGTGCGCACCCCGGCTGACGTGCAAGGGAGCTCGCTGGCCT<br>CTCTGTGCCCTTGTTCTTCCGTGAAATTCTGGCTGAATGTCTCCCCCCACCTTCCGAC<br>GCTGTCTAGGCAAACCTGGATTAGAGTTACATCTCCTGGATGATTAGTTCAGAGATATA<br>TTAAAATGCCCCCTCCCTGTGGATCCTATAG |

Table 4 provides targeting positions with SEQ ID NO: 2425 (NM 001306068.3) for an oligonucleotide of the present disclosure. In some embodiments, an oligonucleotide targets a sequence corresponding to positions selected from Table 4.

TABLE 4

| Targeting positions |
|---|
| 1-19 |
| 2-20 |
| 11-29 |
| 12-30 |
| 13-31 |
| 14-32 |
| 15-33 |
| 16-34 |
| 17-35 |
| 18-36 |
| 19-37 |
| 23-41 |
| 24-42 |
| 25-43 |
| 26-44 |
| 27-45 |
| 28-46 |
| 30-48 |
| 35-53 |
| 37-55 |
| 38-56 |
| 39-57 |
| 40-58 |
| 41-59 |
| 49-67 |
| 50-68 |
| 51-69 |
| 52-70 |
| 53-71 |
| 54-72 |
| 55-73 |
| 56-74 |
| 57-75 |

TABLE 4-continued

| Targeting positions |
|---|
| 60-78 |
| 61-79 |
| 62-80 |
| 63-81 |
| 64-82 |
| 65-83 |
| 66-84 |
| 67-85 |
| 71-89 |
| 76-94 |
| 77-95 |
| 78-96 |
| 79-97 |
| 80-98 |
| 81-99 |
| 82-100 |
| 83-101 |
| 84-102 |
| 85-103 |
| 86-104 |
| 87-105 |
| 88-106 |
| 89-107 |
| 90-108 |
| 108-126 |
| 109-127 |
| 110-128 |
| 111-129 |
| 112-130 |
| 113-131 |
| 114-132 |
| 115-133 |
| 116-134 |
| 124-142 |
| 125-143 |
| 126-144 |
| 127-145 |
| 129-147 |
| 130-148 |
| 131-149 |

TABLE 4-continued

| Targeting positions |
|---|
| 132-150 |
| 133-151 |
| 134-152 |
| 135-153 |
| 136-154 |
| 137-155 |
| 138-156 |
| 144-162 |
| 145-163 |
| 146-164 |
| 147-165 |
| 148-166 |
| 157-175 |
| 158-176 |
| 159-177 |
| 160-178 |
| 161-179 |
| 162-180 |
| 163-181 |
| 164-182 |
| 165-183 |
| 166-184 |
| 167-185 |
| 168-186 |
| 169-187 |
| 170-188 |
| 171-189 |
| 172-190 |
| 173-191 |
| 174-192 |
| 175-193 |
| 176-194 |
| 177-195 |
| 186-204 |
| 187-205 |
| 188-206 |
| 189-207 |
| 190-208 |
| 192-210 |
| 193-211 |
| 194-212 |
| 195-213 |
| 196-214 |
| 197-215 |
| 198-216 |
| 199-217 |
| 200-218 |
| 201-219 |
| 202-220 |
| 203-221 |
| 204-222 |
| 205-223 |
| 206-224 |
| 207-225 |
| 208-226 |
| 209-227 |
| 210-228 |
| 211-229 |
| 212-230 |
| 213-231 |
| 214-232 |
| 215-233 |
| 224-242 |
| 225-243 |
| 226-244 |
| 227-245 |
| 228-246 |
| 229-247 |
| 230-248 |
| 231-249 |
| 232-250 |
| 233-251 |
| 235-253 |
| 236-254 |
| 237-255 |
| 238-256 |
| 239-257 |
| 240-258 |

TABLE 4-continued

| Targeting positions |
|---|
| 241-259 |
| 250-268 |
| 251-269 |
| 252-270 |
| 261-279 |
| 262-280 |
| 263-281 |
| 264-282 |
| 273-291 |
| 274-292 |
| 275-293 |
| 276-294 |
| 277-295 |
| 278-296 |
| 279-297 |
| 280-298 |
| 281-299 |
| 285-303 |
| 286-304 |
| 287-305 |
| 288-306 |
| 289-307 |
| 292-310 |
| 293-311 |
| 294-312 |
| 295-313 |
| 296-314 |
| 297-315 |
| 298-316 |
| 299-317 |
| 300-318 |
| 301-319 |
| 302-320 |
| 303-321 |
| 304-322 |
| 305-323 |
| 306-324 |
| 307-325 |
| 308-326 |
| 309-327 |
| 310-328 |
| 311-329 |
| 312-330 |
| 313-331 |
| 314-332 |
| 315-333 |
| 316-334 |
| 317-335 |
| 325-343 |
| 328-346 |
| 336-354 |
| 337-355 |
| 338-356 |
| 339-357 |
| 340-358 |
| 341-359 |
| 342-360 |
| 343-361 |
| 344-362 |
| 345-363 |
| 346-364 |
| 347-365 |
| 348-366 |
| 349-367 |
| 350-368 |
| 351-369 |
| 352-370 |
| 353-371 |
| 355-373 |
| 359-377 |
| 360-378 |
| 361-379 |
| 362-380 |
| 363-381 |
| 369-387 |
| 370-388 |
| 371-389 |
| 372-390 |

TABLE 4-continued

| Targeting positions |
|---|
| 373-391 |
| 374-392 |
| 375-393 |
| 376-394 |
| 377-395 |
| 378-396 |
| 382-400 |
| 383-401 |
| 384-402 |
| 385-403 |
| 394-412 |
| 395-413 |
| 396-414 |
| 397-415 |
| 398-416 |
| 399-417 |
| 400-418 |
| 401-419 |
| 402-420 |
| 403-421 |
| 404-422 |
| 408-426 |
| 409-427 |
| 410-428 |
| 411-429 |
| 412-430 |
| 420-438 |
| 421-439 |
| 422-440 |
| 423-441 |
| 424-442 |
| 425-443 |
| 426-444 |
| 427-445 |
| 428-446 |
| 429-447 |
| 430-448 |
| 431-449 |
| 432-450 |
| 437-455 |
| 452-470 |
| 453-471 |
| 455-473 |
| 456-474 |
| 458-476 |
| 480-498 |
| 481-499 |
| 482-500 |
| 509-527 |
| 510-528 |
| 511-529 |
| 512-530 |
| 513-531 |
| 514-532 |
| 516-534 |
| 517-535 |
| 518-536 |
| 519-537 |
| 520-538 |
| 521-539 |
| 522-540 |
| 523-541 |
| 524-542 |
| 525-543 |
| 526-544 |
| 530-548 |
| 531-549 |
| 532-550 |
| 533-551 |
| 534-552 |
| 544-562 |
| 545-563 |
| 546-564 |
| 547-565 |
| 548-566 |
| 549-567 |
| 551-569 |
| 552-570 |

TABLE 4-continued

| Targeting positions |
|---|
| 553-571 |
| 565-583 |
| 566-584 |
| 567-585 |
| 575-593 |
| 577-595 |
| 579-597 |
| 581-599 |
| 588-606 |
| 616-634 |
| 617-635 |
| 618-636 |
| 619-637 |
| 620-638 |
| 621-639 |
| 622-640 |
| 627-645 |
| 652-670 |
| 654-672 |
| 659-677 |
| 668-686 |
| 671-689 |
| 672-690 |
| 673-691 |
| 674-692 |
| 675-693 |
| 683-701 |
| 684-702 |
| 685-703 |
| 686-704 |
| 690-708 |
| 692-710 |
| 705-723 |
| 706-724 |
| 707-725 |
| 708-726 |
| 709-727 |
| 710-728 |
| 711-729 |
| 712-730 |
| 713-731 |
| 714-732 |
| 715-733 |
| 717-735 |
| 732-750 |
| 733-751 |
| 745-763 |
| 746-764 |
| 747-765 |
| 748-766 |
| 749-767 |
| 750-768 |
| 751-769 |
| 752-770 |
| 753-771 |
| 754-772 |
| 755-773 |
| 756-774 |
| 757-775 |
| 758-776 |
| 759-777 |
| 760-778 |
| 761-779 |
| 767-785 |
| 768-786 |
| 777-795 |
| 778-796 |
| 779-797 |
| 780-798 |
| 781-799 |
| 782-800 |
| 788-806 |
| 789-807 |
| 790-808 |
| 791-809 |
| 802-820 |
| 809-827 |
| 813-831 |

TABLE 4-continued

| Targeting positions |
|---|
| 827-845 |
| 839-857 |
| 840-858 |
| 841-859 |
| 842-860 |
| 843-861 |
| 845-863 |
| 850-868 |
| 851-869 |
| 852-870 |
| 853-871 |
| 854-872 |
| 856-874 |
| 877-895 |
| 878-896 |
| 879-897 |
| 892-910 |
| 893-911 |
| 894-912 |
| 895-913 |
| 897-915 |
| 901-919 |
| 902-920 |
| 903-921 |
| 911-929 |
| 912-930 |
| 913-931 |
| 914-932 |
| 919-937 |
| 936-954 |
| 939-957 |
| 956-974 |
| 960-978 |
| 975-993 |
| 976-994 |
| 977-995 |
| 983-1001 |
| 984-1002 |
| 985-1003 |
| 986-1004 |
| 989-1007 |
| 992-1010 |
| 994-1012 |
| 1023-1041 |
| 1028-1046 |
| 1030-1048 |
| 1031-1049 |
| 1033-1051 |
| 1034-1052 |
| 1035-1053 |
| 1036-1054 |
| 1037-1055 |
| 1046-1064 |
| 1048-1066 |
| 1049-1067 |
| 1064-1082 |
| 1067-1085 |
| 1081-1099 |
| 1083-1101 |
| 1084-1102 |
| 1085-1103 |
| 1086-1104 |
| 1087-1105 |
| 1088-1106 |
| 1089-1107 |
| 1090-1108 |
| 1091-1109 |
| 1092-1110 |
| 1093-1111 |
| 1094-1112 |
| 1095-1113 |
| 1096-1114 |
| 1097-1115 |
| 1098-1116 |
| 1100-1118 |
| 1101-1119 |
| 1102-1120 |
| 1103-1121 |

TABLE 4-continued

| Targeting positions |
|---|
| 1106-1124 |
| 1107-1125 |
| 1108-1126 |
| 1109-1127 |
| 1110-1128 |
| 1111-1129 |
| 1112-1130 |
| 1113-1131 |
| 1114-1132 |
| 1115-1133 |
| 1116-1134 |
| 1117-1135 |
| 1118-1136 |
| 1119-1137 |
| 1120-1138 |
| 1130-1148 |
| 1131-1149 |
| 1132-1150 |
| 1137-1155 |
| 1138-1156 |
| 1139-1157 |
| 1140-1158 |
| 1141-1159 |
| 1142-1160 |
| 1143-1161 |
| 1144-1162 |
| 1145-1163 |
| 1146-1164 |
| 1147-1165 |
| 1148-1166 |
| 1149-1167 |
| 1150-1168 |
| 1151-1169 |
| 1152-1170 |
| 1153-1171 |
| 1154-1172 |
| 1155-1173 |
| 1156-1174 |
| 1157-1175 |
| 1158-1176 |
| 1159-1177 |
| 1160-1178 |
| 1161-1179 |
| 1162-1180 |
| 1163-1181 |
| 1169-1187 |
| 1170-1188 |
| 1171-1189 |
| 1189-1207 |
| 1192-1210 |
| 1193-1211 |
| 1194-1212 |
| 1212-1230 |
| 1213-1231 |
| 1214-1232 |
| 1215-1233 |
| 1216-1234 |
| 1218-1236 |
| 1234-1252 |
| 1235-1253 |
| 1242-1260 |
| 1251-1269 |
| 1257-1275 |
| 1258-1276 |
| 1260-1278 |
| 1261-1279 |
| 1265-1283 |
| 1266-1284 |
| 1267-1285 |
| 1268-1286 |
| 1269-1287 |
| 1270-1288 |
| 1271-1289 |
| 1272-1290 |
| 1274-1292 |
| 1279-1297 |
| 1284-1302 |
| 1288-1306 |

TABLE 4-continued

| Targeting positions |
|---|
| 1389-1407 |
| 1390-1408 |
| 1400-1418 |
| 1401-1419 |
| 1419-1437 |
| 1420-1438 |
| 1421-1439 |
| 1422-1440 |
| 1425-1443 |
| 1426-1444 |
| 1427-1445 |
| 1428-1446 |
| 1429-1447 |
| 1430-1448 |
| 1570-1588 |
| 1571-1589 |
| 1572-1590 |
| 1573-1591 |
| 1574-1592 |
| 1575-1593 |
| 1576-1594 |
| 1577-1595 |
| 1578-1596 |
| 1589-1607 |
| 1590-1608 |
| 1607-1625 |
| 1608-1626 |
| 1612-1630 |
| 1613-1631 |
| 1614-1632 |
| 1615-1633 |
| 1616-1634 |
| 1617-1635 |
| 1618-1636 |
| 1619-1637 |
| 1620-1638 |
| 1621-1639 |
| 1622-1640 |
| 1623-1641 |
| 1624-1642 |

TABLE 4-continued

| Targeting positions |
|---|
| 1625-1643 |
| 1626-1644 |
| 1627-1645 |
| 1628-1646 |
| 1629-1647 |
| 1630-1648 |
| 1631-1649 |
| 1632-1650 |
| 1633-1651 |
| 1634-1652 |
| 1635-1653 |
| 1636-1654 |
| 1637-1655 |
| 1638-1656 |
| 1639-1657 |
| 1640-1658 |
| 1641-1659 |
| 1642-1660 |
| 1643-1661 |
| 1651-1669 |
| 1652-1670 |
| 1653-1671 |
| 1654-1672 |
| 1655-1673 |
| 1656-1674 |

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the present disclosure may be employed in practicing the present disclosure. It is intended that the following claims define the scope of the present disclosure and that methods and structures within the scope of these claims and their equivalents be covered thereby.

SEQUENCE LISTING (3602 sequences)

SEQ ID NO: 1 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8: note = DNA
  misc_feature 9..18: note = RNA
  misc_feature 19: note = DNA
atggccctcccgacaccct

SEQ ID NO: 2 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..17: note = RNA
  misc_feature 18: note = DNA
  misc_feature 19: note = RNA
tggccctcccgacaccctc

SEQ ID NO: 3 - DNA, 19 bp, synthetic construct
  source 1..19: mol_type = other DNA
  misc_feature 1..8: note = RNA
  misc_feature 9: note = DNA
  misc_feature 10..19: note = RNA
cgacaccctcggacagcac

SEQ ID NO: 4 - DNA, 19 bp, synthetic construct
  source 1..19: mol_type = other DNA
  misc_feature 1..7: note = RNA
  misc_feature 8: note = DNA
  misc_feature 9..19: note = RNA
gacaccctcggacagcacc

SEQ ID NO: 5 - DNA, 19 bp, synthetic construct
  source 1..19: mol_type = other DNA
  misc_feature 1..6: note = RNA
  misc_feature 7: note = DNA
  misc_feature 8..19: note = RNA
acaccctcggacagcaccc

SEQ ID NO: 6 - DNA, 19 bp, synthetic construct
  source 1..19: mol_type = other DNA
  misc_feature 1..5: note = RNA
  misc_feature 6: note = DNA
  misc_feature 7..18: note = RNA
  misc_feature 19: note = DNA
caccctcggacagcaccct

SEQ ID NO: 7 - DNA, 19 bp, synthetic construct
  source 1..19: mol_type = other DNA
  misc_feature 1..4: note = RNA
  misc_feature 5: note = DNA
  misc_feature 6..17: note = RNA
  misc_feature 18: note = DNA
  misc_feature 19: note = RNA
accctcggacagcaccctc

SEQ ID NO: 8 - DNA, 19 bp, synthetic construct
  source 1..19: mol_type = other DNA
  misc_feature 1..3: note = RNA
  misc_feature 4: note = DNA
  misc_feature 5..16: note = RNA
  misc_feature 17: note = DNA
  misc_feature 18..19: note = RNA
ccctcggacagcaccctcc

SEQ ID NO: 9 - DNA, 19 bp, synthetic construct
  source 1..19: mol_type = other DNA
  misc_feature 1..2: note = RNA
  misc_feature 3: note = DNA
  misc_feature 4..15: note = RNA
  misc_feature 16: note = DNA
  misc_feature 17..19: note = RNA
cctcggacagcaccctccc

SEQ ID NO: 10 - DNA, 19 bp, synthetic construct
  source 1..19: mol_type = other DNA
  misc_feature 1: note = RNA
  misc_feature 2: note = DNA
  misc_feature 3..14: note = RNA
  misc_feature 15: note = DNA
  misc_feature 16..19: note = RNA
ctcggacagcaccctcccc

SEQ ID NO: 11 - DNA, 19 bp, synthetic construct
  source 1..19: mol_type = other DNA
  misc_feature 1: note = DNA
  misc_feature 2..13: note = RNA
  misc_feature 14: note = DNA
  misc_feature 15..19: note = RNA
tcggacagcaccctccccg

SEQ ID NO: 12 - DNA, 19 bp, synthetic construct
  source 1..19: mol_type = other DNA
  misc_feature 1..9: note = RNA
  misc_feature 10: note = DNA
  misc_feature 11..19: note = RNA
acagcaccctccccgcgga

SEQ ID NO: 13 - DNA, 19 bp, synthetic construct
  source 1..19: mol_type = other DNA
  misc_feature 1..8: note = RNA
  misc_feature 9: note = DNA
  misc_feature 10..19: note = RNA
cagcaccctccccgcggaa

SEQ ID NO: 14 - DNA, 19 bp, synthetic construct
  source 1..19: mol_type = other DNA
  misc_feature 1..7: note = RNA
  misc_feature 8: note = DNA
  misc_feature 9..19: note = RNA
agcaccctccccgcggaag

SEQ ID NO: 15 - RNA, 19 nt, synthetic construct
  source 1..19: mol_type = other RNA
ggaagcccggggacgagga

SEQ ID NO: 16 - RNA, 19 nt, synthetic construct
  source 1..19: mol_type = other RNA
gaagcccggggacgaggac

SEQ ID NO: 17 - RNA, 19 nt, synthetic construct
  source 1..19: mol_type = other RNA
aagcccggggacgaggacg

SEQ ID NO: 18 - RNA, 19 nt, synthetic construct
  source 1..19: mol_type = other RNA
ggacgaggacggcgacgga

SEQ ID NO: 19 - RNA, 19 nt, synthetic construct
  source 1..19: mol_type = other RNA
gacgaggacggcgacggag

SEQ ID NO: 20 - RNA, 19 nt, synthetic construct
  source 1..19: mol_type = other RNA
acgaggacggcgacggaga

SEQ ID NO: 21 - RNA, 19 nt, synthetic construct
  source 1..19: mol_type = other RNA
cgaggacggcgacggagac

SEQ ID NO: 22 - DNA, 19 bp, synthetic construct
  source 1..19: mol_type = other DNA
  misc_feature 1..18: note = RNA
  misc_feature 19: note = DNA
gaggacggcgacggagact

SEQ ID NO: 23 - DNA, 19 bp, synthetic construct
  source 1..19: mol_type = other DNA
  misc_feature 1..17: note = RNA
  misc_feature 18: note = DNA
  misc_feature 19: note = RNA
aggacggcgacggagactc

SEQ ID NO: 24 - DNA, 19 bp, synthetic construct
  source 1..19: mol_type = other DNA
  misc_feature 1..16: note = RNA
  misc_feature 17: note = DNA
  misc_feature 18..19: note = RNA
ggacggcgacggagactcg

SEQ ID NO: 25 - DNA, 19 bp, synthetic construct
  source 1..19: mol_type = other DNA
  misc_feature 1..15: note = RNA
  misc_feature 16: note = DNA
  misc_feature 17..18: note = RNA
  misc_feature 19: note = DNA
gacggcgacggagactcgt

SEQ ID NO: 26 - DNA, 19 bp, synthetic construct
  source 1..19: mol_type = other DNA
  misc_feature 1..14: note = RNA
  misc_feature 15: note = DNA
  misc_feature 16..17: note = RNA
  misc_feature 18..19: note = DNA
acggcgacggagactcgtt

SEQ ID NO: 27 - DNA, 19 bp, synthetic construct
  source 1..19: mol_type = other DNA
  misc_feature 1..11: note = RNA
  misc_feature 12: note = DNA
  misc_feature 13..14: note = RNA
  misc_feature 15..17: note = DNA
  misc_feature 18..19: note = RNA
gcgacggagactcgtttgg

SEQ ID NO: 28 - DNA, 19 bp, synthetic construct
  source 1..19: mol_type = other DNA
  misc_feature 1..10: note = RNA
  misc_feature 11: note = DNA
  misc_feature 12..13: note = RNA
  misc_feature 14..16: note = DNA
  misc_feature 17..19: note = RNA
cgacggagactcgtttgga

SEQ ID NO: 29 - DNA, 19 bp, synthetic construct
  source 1..19: mol_type = other DNA
  misc_feature 1..9: note = RNA
  misc_feature 10: note = DNA
  misc_feature 11..12: note = RNA
  misc_feature 13..15: note = DNA
  misc_feature 16..19: note = RNA
gacggagactcgtttggac

SEQ ID NO: 30 - DNA, 19 bp, synthetic construct
  source 1..19: mol_type = other DNA
  misc_feature 1..8: note = RNA
  misc_feature 9: note = DNA
  misc_feature 10..11: note = RNA
  misc_feature 12..14: note = DNA
  misc_feature 15..19: note = RNA
acggagactcgtttggacc

SEQ ID NO: 31 - DNA, 19 bp, synthetic construct
  source 1..19: mol_type = other DNA
  misc_feature 1..7: note = RNA
  misc_feature 8: note = DNA
  misc_feature 9..10: note = RNA
  misc_feature 11..13: note = DNA
  misc_feature 14..19: note = RNA
cggagactcgtttggaccc

SEQ ID NO: 32 - DNA, 19 bp, synthetic construct
  source 1..19: mol_type = other DNA
  misc_feature 1..6: note = RNA
  misc_feature 7: note = DNA
  misc_feature 8..9: note = RNA
  misc_feature 10..12: note = DNA
  misc_feature 13..19: note = RNA
ggagactcgtttggacccc

SEQ ID NO: 33 - DNA, 19 bp, synthetic construct
  source 1..19: mol_type = other DNA
  misc_feature 1..5: note = RNA
  misc_feature 6: note = DNA
  misc_feature 7..8: note = RNA
  misc_feature 9..11: note = DNA
  misc_feature 12..19: note = RNA
gagactcgtttggaccccg

SEQ ID NO: 34 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8..10: note = DNA
  misc_feature 11..19: note = RNA
agactcgtttggaccccga

SEQ ID NO: 35 - DNA, 19 bp, synthetic construct
  source 1..19: mol_type = other DNA
  misc_feature 1: note = DNA
  misc_feature 2..3: note = RNA
  misc_feature 4..6: note = DNA
  misc_feature 7..19: note = RNA
tcgtttggaccccgagcca

SEQ ID NO: 36 - DNA, 19 bp, synthetic construct
  source 1..19: mol_type = other DNA
  misc_feature 1: note = DNA
  misc_feature 2..19: note = RNA
tggaccccgagccaaagcg

SEQ ID NO: 37 - RNA, 19 nt, synthetic construct
  source 1..19: mol_type = other RNA
ggaccccgagccaaagcga

SEQ ID NO: 38 - RNA, 19 nt, synthetic construct
  source 1..19: mol_type = other RNA
gaccccgagccaaagcgag

SEQ ID NO: 39 - RNA, 19 nt, synthetic construct
  source 1..19: mol_type = other RNA
accccgagccaaagcgagg

SEQ ID NO: 40 - RNA, 19 nt, synthetic construct
  source 1..19: mol_type = other RNA
ccccgagccaaagcgaggc

SEQ ID NO: 41 - RNA, 19 nt, synthetic construct
  source 1..19: mol_type = other RNA
cccgagccaaagcgaggcc

SEQ ID NO: 42 - RNA, 19 nt, synthetic construct
  source 1..19: mol_type = other RNA
ccgagccaaagcgaggccc

SEQ ID NO: 43 - DNA, 19 bp, synthetic construct
  source 1..19: mol_type = other DNA
  misc_feature 1..18: note = RNA
  misc_feature 19: note = DNA
cgagccaaagcgaggccct

SEQ ID NO: 44 - DNA, 19 bp, synthetic construct
  source 1..19: mol_type = other DNA
  misc_feature 1..17: note = RNA
  misc_feature 18: note = DNA
  misc_feature 19: note = RNA
gagccaaagcgaggccctg

SEQ ID NO: 45 - DNA, 19 bp, synthetic construct
  source 1..19: mol_type = other DNA
  misc_feature 1..16: note = RNA
  misc_feature 17: note = DNA
  misc_feature 18..19: note = RNA
agccaaagcgaggccctgc

SEQ ID NO: 46 - DNA, 19 bp, synthetic construct
  source 1..19: mol_type = other DNA
  misc_feature 1..15: note = RNA
  misc_feature 16: note = DNA
  misc_feature 17..19: note = RNA
gccaaagcgaggccctgcg

SEQ ID NO: 47 - DNA, 19 bp, synthetic construct
  source 1..19: mol_type = other DNA
  misc_feature 1..14: note = RNA
  misc_feature 15: note = DNA
  misc_feature 16..19: note = RNA
ccaaagcgaggccctgcga

SEQ ID NO: 48 - DNA, 19 bp, synthetic construct
  source 1..19: mol_type = other DNA
  misc_feature 1..13: note = RNA
  misc_feature 14: note = DNA
  misc_feature 15..19: note = RNA
caaagcgaggccctgcgag

SEQ ID NO: 49 - DNA, 19 bp, synthetic construct
  source 1..19: mol_type = other DNA
  misc_feature 1..12: note = RNA
  misc_feature 13: note = DNA
  misc_feature 14..19: note = RNA
aaagcgaggccctgcgagc

SEQ ID NO: 50 - DNA, 19 bp, synthetic construct
  source 1..19: mol_type = other DNA
  misc_feature 1..11: note = RNA
  misc_feature 12: note = DNA
  misc_feature 13..19: note = RNA
aagcgaggccctgcgagcc

SEQ ID NO: 51 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5..7: note = DNA
  misc_feature 8..19: note = RNA
ctgctttgagcggaacccg

SEQ ID NO: 52 - DNA, 19 bp, synthetic construct
  source 1..19: mol_type = other DNA
  misc_feature 1: note = DNA
  misc_feature 2..3: note = RNA
  misc_feature 4..6: note = DNA
  misc_feature 7..18: note = RNA
  misc_feature 19: note = DNA
tgctttgagcggaacccgt

SEQ ID NO: 53 - DNA, 19 bp, synthetic construct
  source 1..19: mol_type = other DNA
  misc_feature 1..2: note = RNA
  misc_feature 3..5: note = DNA
  misc_feature 6..17: note = RNA
  misc_feature 18: note = DNA
  misc_feature 19: note = RNA
gctttgagcggaacccgta

SEQ ID NO: 54 - DNA, 19 bp, synthetic construct
  source 1..19: mol_type = other DNA
  misc_feature 1: note = RNA
  misc_feature 2..4: note = DNA
  misc_feature 5..16: note = RNA
  misc_feature 17: note = DNA
  misc_feature 18..19: note = RNA
ctttgagcggaacccgtac

SEQ ID NO: 55 - DNA, 19 bp, synthetic construct
  source 1..19: mol_type = other DNA
  misc_feature 1..3: note = DNA
  misc_feature 4..15: note = RNA
  misc_feature 16: note = DNA
  misc_feature 17..19: note = RNA
tttgagcggaacccgtacc

SEQ ID NO: 56 - DNA, 19 bp, synthetic construct
  source 1..19: mol_type = other DNA
  misc_feature 1..2: note = DNA
  misc_feature 3..14: note = RNA
  misc_feature 15: note = DNA
  misc_feature 16..19: note = RNA
ttgagcggaacccgtaccc

SEQ ID NO: 57 - DNA, 19 bp, synthetic construct
  source 1..19: mol_type = other DNA
  misc_feature 1: note = DNA
  misc_feature 2..13: note = RNA
  misc_feature 14: note = DNA
  misc_feature 15..19: note = RNA
tgagcggaacccgtacccg

SEQ ID NO: 58 - DNA, 19 bp, synthetic construct
  source 1..19: mol_type = other DNA
  misc_feature 1..12: note = RNA
  misc_feature 13: note = DNA
  misc_feature 14..19: note = RNA
gagcggaacccgtacccgg

SEQ ID NO: 59 - DNA, 19 bp, synthetic construct
  source 1..19: mol_type = other DNA
  misc_feature 1..11: note = RNA
  misc_feature 12: note = DNA
  misc_feature 13..19: note = RNA
agcggaacccgtacccggg

SEQ ID NO: 60 - DNA, 19 bp, synthetic construct
  source 1..19: mol_type = other DNA
  misc_feature 1..3: note = RNA
  misc_feature 4: note = DNA
  misc_feature 5..13: note = RNA
  misc_feature 14: note = DNA
  misc_feature 15..19: note = RNA
ccgtacccgggcatcgcca

SEQ ID NO: 61 - DNA, 19 bp, synthetic construct
  source 1..19: mol_type = other DNA
  misc_feature 1..2: note = RNA
  misc_feature 3: note = DNA
  misc_feature 4..12: note = RNA
  misc_feature 13: note = DNA
  misc_feature 14..19: note = RNA
cgtacccgggcatcgccac

SEQ ID NO: 62 - DNA, 19 bp, synthetic construct
  source 1..19: mol_type = other DNA
  misc_feature 1: note = RNA
  misc_feature 2: note = DNA
  misc_feature 3..11: note = RNA
  misc_feature 12: note = DNA
  misc_feature 13..19: note = RNA
gtacccgggcatcgccacc

SEQ ID NO: 63 - DNA, 19 bp, synthetic construct
  source 1..19: mol_type = other DNA
  misc_feature 1: note = DNA
  misc_feature 2..10: note = RNA
  misc_feature 11: note = DNA
  misc_feature 12..19: note = RNA
tacccgggcatcgccacca

SEQ ID NO: 64 - DNA, 19 bp, synthetic construct
  source 1..19: mol_type = other DNA
  misc_feature 1..8: note = RNA
  misc_feature 9: note = DNA
  misc_feature 10..19: note = RNA
cccgggcatcgccaccaga

SEQ ID NO: 65 - DNA, 19 bp, synthetic construct
  source 1..19: mol_type = other DNA
  misc_feature 1..7: note = RNA
  misc_feature 8: note = DNA
  misc_feature 9..19: note = RNA
ccgggcatcgccaccagag

SEQ ID NO: 66 - DNA, 19 bp, synthetic construct
  source 1..19: mol_type = other DNA
  misc_feature 1..6: note = RNA
  misc_feature 7: note = DNA
  misc_feature 8..19: note = RNA
cgggcatcgccaccagaga

SEQ ID NO: 67 - DNA, 19 bp, synthetic construct
  source 1..19: mol_type = other DNA
  misc_feature 1..5: note = RNA
  misc_feature 6: note = DNA
  misc_feature 7..19: note = RNA
gggcatcgccaccagagaa

SEQ ID NO: 68 - DNA, 19 bp, synthetic construct
  source 1..19: mol_type = other DNA
  misc_feature 1..4: note = RNA
  misc_feature 5: note = DNA
  misc_feature 6..19: note = RNA
ggcatcgccaccagagaac

SEQ ID NO: 69 - DNA, 19 bp, synthetic construct
  source 1..19: mol_type = other DNA
  misc_feature 1..3: note = RNA
  misc_feature 4: note = DNA
  misc_feature 5..19: note = RNA
gcatcgccaccagagaacg

SEQ ID NO: 70 - DNA, 19 bp, synthetic construct
  source 1..19: mol_type = other DNA
  misc_feature 1..2: note = RNA
  misc_feature 3: note = DNA
  misc_feature 4..19: note = RNA
catcgccaccagagaacgg

SEQ ID NO: 71 - DNA, 19 bp, synthetic construct
  source 1..19: mol_type = other DNA
  misc_feature 1: note = RNA
  misc_feature 2: note = DNA
  misc_feature 3..19: note = RNA
atcgccaccagagaacggc

SEQ ID NO: 72 - DNA, 19 bp, synthetic construct
  source 1..19: mol_type = other DNA
  misc_feature 1: note = DNA
  misc_feature 2..18: note = RNA
  misc_feature 19: note = DNA
tcgccaccagagaacggct

SEQ ID NO: 73 - DNA, 19 bp, synthetic construct
  source 1..19: mol_type = other DNA
  misc_feature 1..17: note = RNA
  misc_feature 18: note = DNA
  misc_feature 19: note = RNA
cgccaccagagaacggctg

SEQ ID NO: 74 - DNA, 19 bp, synthetic construct
  source 1..19: mol_type = other DNA
  misc_feature 1..11: note = RNA
  misc_feature 12: note = DNA
  misc_feature 13..19: note = RNA
cagagaacggctggcccag

SEQ ID NO: 75 - DNA, 19 bp, synthetic construct
  source 1..19: mol_type = other DNA
  misc_feature 1..10: note = RNA
  misc_feature 11: note = DNA
  misc_feature 12..19: note = RNA
agagaacggctggcccagg

SEQ ID NO: 76 - DNA, 19 bp, synthetic construct
  source 1..19: mol_type = other DNA
  misc_feature 1..9: note = RNA
  misc_feature 10: note = DNA
  misc_feature 11..19: note = RNA
gagaacggctggcccaggc

SEQ ID NO: 77 - DNA, 19 bp, synthetic construct
  source 1..19: mol_type = other DNA
  misc_feature 1..8: note = RNA
  misc_feature 9: note = DNA
  misc_feature 10..19: note = RNA
agaacggctggcccaggcc

SEQ ID NO: 78 - DNA, 19 bp, synthetic construct
  source 1..19: mol_type = other DNA
  misc_feature 1..7: note = RNA
  misc_feature 8: note = DNA
  misc_feature 9..19: note = RNA
gaacggctggcccaggcca

SEQ ID NO: 79 - DNA, 19 bp, synthetic construct
  source 1..19: mol_type = other DNA
  misc_feature 1..10: note = RNA
  misc_feature 11: note = DNA
  misc_feature 12..16: note = RNA
  misc_feature 17..18: note = DNA
  misc_feature 19: note = RNA
gcccaggccatcggcattc

SEQ ID NO: 80 - DNA, 19 bp, synthetic construct
  source 1..19: mol_type = other DNA
  misc_feature 1..9: note = RNA
  misc_feature 10: note = DNA
  misc_feature 11..15: note = RNA
  misc_feature 16..17: note = DNA
  misc_feature 18..19: note = RNA
cccaggccatcggcattcc

SEQ ID NO: 81 - DNA, 19 bp, synthetic construct
  source 1..19: mol_type = other DNA
  misc_feature 1..8: note = RNA
  misc_feature 9: note = DNA
  misc_feature 10..14: note = RNA
  misc_feature 15..16: note = DNA
  misc_feature 17..19: note = RNA
ccaggccatcggcattccg

SEQ ID NO: 82 - DNA, 19 bp, synthetic construct
  source 1..19: mol_type = other DNA
  misc_feature 1..7: note = RNA
  misc_feature 8: note = DNA
  misc_feature 9..13: note = RNA
  misc_feature 14..15: note = DNA
  misc_feature 16..19: note = RNA
caggccatcggcattccgg

SEQ ID NO: 83 - DNA, 19 bp, synthetic construct
  source 1..19: mol_type = other DNA
  misc_feature 1..6: note = RNA
  misc_feature 7: note = DNA
  misc_feature 8..12: note = RNA
  misc_feature 13..14: note = DNA
  misc_feature 15..19: note = RNA
aggccatcggcattccgga

SEQ ID NO: 84 - DNA, 19 bp, synthetic construct
  source 1..19: mol_type = other DNA
  misc_feature 1..5: note = RNA
  misc_feature 6: note = DNA
  misc_feature 7..11: note = RNA
  misc_feature 12..13: note = DNA
  misc_feature 14..19: note = RNA
ggccatcggcattccggag

SEQ ID NO: 85 - DNA, 19 bp, synthetic construct
  source 1..19: mol_type = other DNA
  misc_feature 1..4: note = RNA
  misc_feature 5: note = DNA
  misc_feature 6..10: note = RNA
  misc_feature 11..12: note = DNA
  misc_feature 13..19: note = RNA
gccatcggcattccggagc

SEQ ID NO: 86 - DNA, 19 bp, synthetic construct
  source 1..19: mol_type = other DNA
  misc_feature 1..3: note = RNA
  misc_feature 4: note = DNA
  misc_feature 5..9: note = RNA
  misc_feature 10..11: note = DNA
  misc_feature 12..19: note = RNA
ccatcggcattccggagcc

SEQ ID NO: 87 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9..10: note = DNA
  misc_feature 11..19: note = RNA
catcggcattccggagccc

SEQ ID NO: 88 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8..9: note = DNA
  misc_feature 10..19: note = RNA
atcggcattccggagccca

SEQ ID NO: 89 - DNA, 19 bp, synthetic construct
  source 1..19: mol_type = other DNA
  misc_feature 1: note = DNA
  misc_feature 2..6: note = RNA
  misc_feature 7..8: note = DNA
  misc_feature 9..19: note = RNA
tcggcattccggagcccag

SEQ ID NO: 90 - DNA, 19 bp, synthetic construct
  source 1..19: mol_type = other DNA
  misc_feature 1..5: note = RNA
  misc_feature 6..7: note = DNA
  misc_feature 8..19: note = RNA
cggcattccggagcccagg

SEQ ID NO: 91 - DNA, 19 bp, synthetic construct
  source 1..19: mol_type = other DNA
  misc_feature 1..4: note = RNA
  misc_feature 5..6: note = DNA
  misc_feature 7..19: note = RNA
ggcattccggagcccaggg

SEQ ID NO: 92 - DNA, 19 bp, synthetic construct
  source 1..19: mol_type = other DNA
  misc_feature 1..3: note = RNA
  misc_feature 4..5: note = DNA
  misc_feature 6..18: note = RNA
  misc_feature 19: note = DNA
gcattccggagcccagggt

SEQ ID NO: 93 - DNA, 19 bp, synthetic construct
  source 1..19: mol_type = other DNA
  misc_feature 1..2: note = RNA
  misc_feature 3..4: note = DNA
  misc_feature 5..17: note = RNA
  misc_feature 18: note = DNA
  misc_feature 19: note = RNA
cattccggagcccagggtc

SEQ ID NO: 94 - DNA, 19 bp, synthetic construct
  source 1..19: mol_type = other DNA
  misc_feature 1: note = RNA
  misc_feature 2..3: note = DNA
  misc_feature 4..16: note = RNA
  misc_feature 17: note = DNA
  misc_feature 18..19: note = RNA
attccggagcccagggtcc

SEQ ID NO: 95 - DNA, 19 bp, synthetic construct
  source 1..19: mol_type = other DNA
  misc_feature 1..2: note = DNA
  misc_feature 3..15: note = RNA
  misc_feature 16: note = DNA
  misc_feature 17..19: note = RNA
ttccggagcccagggtcca

SEQ ID NO: 96 - DNA, 19 bp, synthetic construct
  source 1..19: mol_type = other DNA
  misc_feature 1: note = DNA
  misc_feature 2..14: note = RNA
  misc_feature 15: note = DNA
  misc_feature 16..19: note = RNA
tccggagcccagggtccag

SEQ ID NO: 97 - DNA, 19 bp, synthetic construct
  source 1..19: mol_type = other DNA
  misc_feature 1..13: note = RNA
  misc_feature 14: note = DNA
  misc_feature 15..19: note = RNA
ccggagcccagggtccaga

SEQ ID NO: 98 - DNA, 19 bp, synthetic construct
  source 1..19: mol_type = other DNA
  misc_feature 1..12: note = RNA
  misc_feature 13: note = DNA
  misc_feature 14..18: note = RNA
  misc_feature 19: note = DNA
cggagcccagggtccagat

SEQ ID NO: 99 - DNA, 19 bp, synthetic construct
  source 1..19: mol_type = other DNA
  misc_feature 1..11: note = RNA
  misc_feature 12: note = DNA
  misc_feature 13..17: note = RNA
  misc_feature 18..19: note = DNA
ggagcccagggtccagatt

SEQ ID NO: 100 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9..11: note = DNA
  misc_feature 12..13: note = RNA
  misc_feature 14..16: note = DNA
  misc_feature 17..19: note = RNA
ggtccagatttggtttcag

SEQ ID NO: 101 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8..10: note = DNA
  misc_feature 11..12: note = RNA
  misc_feature 13..15: note = DNA
  misc_feature 16..19: note = RNA
gtccagatttggtttcaga

SEQ ID NO: 102 - DNA, 19 bp, synthetic construct
  source 1..19: mol_type = other DNA
  misc_feature 1: note = DNA
  misc_feature 2..6: note = RNA
  misc_feature 7..9: note = DNA
  misc_feature 10..11: note = RNA
  misc_feature 12..14: note = DNA
  misc_feature 15..19: note = RNA
tccagatttggtttcagaa

SEQ ID NO: 103 - DNA, 19 bp, synthetic construct
  source 1..19: mol_type = other DNA
  misc_feature 1..5: note = RNA
  misc_feature 6..8: note = DNA
  misc_feature 9..10: note = RNA
  misc_feature 11..13: note = DNA
  misc_feature 14..18: note = RNA
  misc_feature 19: note = DNA
ccagatttggtttcagaat

SEQ ID NO: 104 - DNA, 19 bp, synthetic construct
  source 1..19: mol_type = other DNA
  misc_feature 1..4: note = RNA
  misc_feature 5..7: note = DNA
  misc_feature 8..9: note = RNA
  misc_feature 10..12: note = DNA
  misc_feature 13..17: note = RNA
  misc_feature 18: note = DNA
  misc_feature 19: note = RNA
cagatttggtttcagaatg

SEQ ID NO: 105 - DNA, 19 bp, synthetic construct
  source 1..19: mol_type = other DNA
  misc_feature 1..2: note = RNA
  misc_feature 3..5: note = DNA
  misc_feature 6..7: note = RNA
  misc_feature 8..10: note = DNA
  misc_feature 11..15: note = RNA
  misc_feature 16: note = DNA
  misc_feature 17..19: note = RNA
gatttggtttcagaatgag

SEQ ID NO: 106 - DNA, 19 bp, synthetic construct
  source 1..19: mol_type = other DNA
  misc_feature 1..3: note = DNA
  misc_feature 4..5: note = RNA
  misc_feature 6..8: note = DNA
  misc_feature 9..13: note = RNA
  misc_feature 14: note = DNA
  misc_feature 15..19: note = RNA
tttggtttcagaatgagag

SEQ ID NO: 107 - DNA, 19 bp, synthetic construct
  source 1..19: mol_type = other DNA
  misc_feature 1..2: note = DNA
  misc_feature 3..4: note = RNA
  misc_feature 5..7: note = DNA
  misc_feature 8..12: note = RNA
  misc_feature 13: note = DNA
  misc_feature 14..19: note = RNA
ttggtttcagaatgagagg

SEQ ID NO: 108 - DNA, 19 bp, synthetic construct
  source 1..19: mol_type = other DNA
  misc_feature 1: note = DNA
  misc_feature 2..3: note = RNA
  misc_feature 4..6: note = DNA
  misc_feature 7..11: note = RNA
  misc_feature 12: note = DNA
  misc_feature 13..18: note = RNA
  misc_feature 19: note = DNA
tggtttcagaatgagaggt

SEQ ID NO: 109 - DNA, 19 bp, synthetic construct
  source 1..19: mol_type = other DNA
  misc_feature 1..2: note = RNA
  misc_feature 3..5: note = DNA
  misc_feature 6..10: note = RNA
  misc_feature 11: note = DNA
  misc_feature 12..17: note = RNA
  misc_feature 18: note = DNA
  misc_feature 19: note = RNA
ggtttcagaatgagaggtc

SEQ ID NO: 110 - DNA, 19 bp, synthetic construct
  source 1..19: mol_type = other DNA
  misc_feature 1: note = RNA
  misc_feature 2..4: note = DNA
  misc_feature 5..9: note = RNA
  misc_feature 10: note = DNA
  misc_feature 11..16: note = RNA
  misc_feature 17: note = DNA
  misc_feature 18..19: note = RNA
gtttcagaatgagaggtca

SEQ ID NO: 111 - DNA, 19 bp, synthetic construct
  source 1..19: mol_type = other DNA
  misc_feature 1..3: note = DNA
  misc_feature 4..8: note = RNA
  misc_feature 9: note = DNA
  misc_feature 10..15: note = RNA
  misc_feature 16: note = DNA
  misc_feature 17..19: note = RNA
tttcagaatgagaggtcac

SEQ ID NO: 112 - DNA, 19 bp, synthetic construct
  source 1..19: mol_type = other DNA
  misc_feature 1..2: note = DNA
  misc_feature 3..7: note = RNA
  misc_feature 8: note = DNA
  misc_feature 9..14: note = RNA
  misc_feature 15: note = DNA
  misc_feature 16..19: note = RNA
ttcagaatgagaggtcacg

SEQ ID NO: 113 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..13: note = RNA
  misc_feature 14: note = DNA
  misc_feature 15..19: note = RNA
tcagaatgagaggtcacgc

SEQ ID NO: 114 - DNA, 19 bp, synthetic construct
  source 1..19: mol_type = other DNA
  misc_feature 1..5: note = RNA
  misc_feature 6: note = DNA
  misc_feature 7..12: note = RNA
  misc_feature 13: note = DNA
  misc_feature 14..19: note = RNA
cagaatgagaggtcacgcc

SEQ ID NO: 115 - DNA, 19 bp, synthetic construct
  source 1..19: mol_type = other DNA
  misc_feature 1..4: note = RNA
  misc_feature 5: note = DNA
  misc_feature 6..11: note = RNA
  misc_feature 12: note = DNA
  misc_feature 13..19: note = RNA
agaatgagaggtcacgcca

SEQ ID NO: 116 - DNA, 19 bp, synthetic construct
  source 1..19: mol_type = other DNA
  misc_feature 1..3: note = RNA
  misc_feature 4: note = DNA
  misc_feature 5..10: note = RNA
  misc_feature 11: note = DNA
  misc_feature 12..19: note = RNA
gaatgagaggtcacgccag

SEQ ID NO: 117 - DNA, 19 bp, synthetic construct
  source 1..19: mol_type = other DNA
  misc_feature 1..2: note = RNA
  misc_feature 3: note = DNA
  misc_feature 4..9: note = RNA
  misc_feature 10: note = DNA
  misc_feature 11..19: note = RNA
aatgagaggtcacgccagc

SEQ ID NO: 118 - DNA, 19 bp, synthetic construct
  source 1..19: mol_type = other DNA
  misc_feature 1: note = RNA
  misc_feature 2: note = DNA
  misc_feature 3..8: note = RNA
  misc_feature 9: note = DNA
  misc_feature 10..18: note = RNA
  misc_feature 19: note = DNA
atgagaggtcacgccagct

SEQ ID NO: 119 - DNA, 19 bp, synthetic construct
  source 1..19: mol_type = other DNA
  misc_feature 1: note = DNA
  misc_feature 2..7: note = RNA
  misc_feature 8: note = DNA
  misc_feature 9..17: note = RNA
  misc_feature 18: note = DNA
  misc_feature 19: note = RNA
tgagaggtcacgccagctg

SEQ ID NO: 120 - DNA, 19 bp, synthetic construct
  source 1..19: mol_type = other DNA
  misc_feature 1..6: note = RNA
  misc_feature 7: note = DNA
  misc_feature 8..16: note = RNA
  misc_feature 17: note = DNA
  misc_feature 18..19: note = RNA
gagaggtcacgccagctga

SEQ ID NO: 121 - DNA, 19 bp, synthetic construct
  source 1..19: mol_type = other DNA
  misc_feature 1..5: note = RNA
  misc_feature 6: note = DNA
  misc_feature 7..15: note = RNA
  misc_feature 16: note = DNA
  misc_feature 17..19: note = RNA
agaggtcacgccagctgag

SEQ ID NO: 122 - DNA, 19 bp, synthetic construct
  source 1..19: mol_type = other DNA
  misc_feature 1..4: note = RNA
  misc_feature 5: note = DNA
  misc_feature 6..14: note = RNA
  misc_feature 15: note = DNA
  misc_feature 16..19: note = RNA
gaggtcacgccagctgagg

SEQ ID NO: 123 - DNA, 19 bp, synthetic construct
  source 1..19: mol_type = other DNA
  misc_feature 1..3: note = RNA
  misc_feature 4: note = DNA
  misc_feature 5..13: note = RNA
  misc_feature 14: note = DNA
  misc_feature 15..19: note = RNA
aggtcacgccagctgaggc

SEQ ID NO: 124 - DNA, 19 bp, synthetic construct
  source 1..19: mol_type = other DNA
  misc_feature 1..2: note = RNA
  misc_feature 3: note = DNA
  misc_feature 4..12: note = RNA
  misc_feature 13: note = DNA
  misc_feature 14..19: note = RNA
ggtcacgccagctgaggca

SEQ ID NO: 125 - DNA, 19 bp, synthetic construct
  source 1..19: mol_type = other DNA
  misc_feature 1: note = RNA
  misc_feature 2: note = DNA
  misc_feature 3..11: note = RNA
  misc_feature 12: note = DNA
  misc_feature 13..19: note = RNA
gtcacgccagctgaggcag

SEQ ID NO: 126 - DNA, 19 bp, synthetic construct
  source 1..19: mol_type = other DNA
  misc_feature 1: note = DNA
  misc_feature 2..10: note = RNA
  misc_feature 11: note = DNA
  misc_feature 12..19: note = RNA
tcacgccagctgaggcagc

SEQ ID NO: 127 - DNA, 19 bp, synthetic construct
  source 1..19: mol_type = other DNA
  misc_feature 1..9: note = RNA
  misc_feature 10: note = DNA
  misc_feature 11..19: note = RNA
cacgccagctgaggcagca

SEQ ID NO: 128 - DNA, 19 bp, synthetic construct
  source 1..19: mol_type = other DNA
  misc_feature 1: note = DNA
  misc_feature 2..19: note = RNA
tgaggcagcaccggcggga

SEQ ID NO: 129 - RNA, 19 nt, synthetic construct
  source 1..19: mol_type = other RNA
gaggcagcaccggcgggaa

SEQ ID NO: 130 - DNA, 19 bp, synthetic construct
  source 1..19: mol_type = other DNA
  misc_feature 1..18: note = RNA
  misc_feature 19: note = DNA
aggcagcaccggcgggaat

SEQ ID NO: 131 - DNA, 19 bp, synthetic construct
  source 1..19: mol_type = other DNA
  misc_feature 1..17: note = RNA
  misc_feature 18: note = DNA
  misc_feature 19: note = RNA
ggcagcaccggcgggaatc

SEQ ID NO: 132 - DNA, 19 bp, synthetic construct
  source 1..19: mol_type = other DNA
  misc_feature 1..16: note = RNA
  misc_feature 17: note = DNA
  misc_feature 18: note = RNA
  misc_feature 19: note = DNA
gcagcaccggcgggaatct

SEQ ID NO: 133 - DNA, 19 bp, synthetic construct
  source 1..19: mol_type = other DNA
  misc_feature 1..15: note = RNA
  misc_feature 16: note = DNA
  misc_feature 17: note = RNA
  misc_feature 18: note = DNA
  misc_feature 19: note = RNA
cagcaccggcgggaatctc

SEQ ID NO: 134 - DNA, 19 bp, synthetic construct
  source 1..19: mol_type = other DNA
  misc_feature 1..14: note = RNA
  misc_feature 15: note = DNA
  misc_feature 16: note = RNA
  misc_feature 17: note = DNA
  misc_feature 18..19: note = RNA
agcaccggcgggaatctcg

SEQ ID NO: 135 - DNA, 19 bp, synthetic construct
  source 1..19: mol_type = other DNA
  misc_feature 1..13: note = RNA
  misc_feature 14: note = DNA
  misc_feature 15: note = RNA
  misc_feature 16: note = DNA
  misc_feature 17..19: note = RNA
gcaccggcgggaatctcgg

SEQ ID NO: 136 - DNA, 19 bp, synthetic construct
  source 1..19: mol_type = other DNA
  misc_feature 1..12: note = RNA
  misc_feature 13: note = DNA
  misc_feature 14: note = RNA
  misc_feature 15: note = DNA
  misc_feature 16..19: note = RNA
caccggcgggaatctcggc

SEQ ID NO: 137 - DNA, 19 bp, synthetic construct
  source 1..19: mol_type = other DNA
  misc_feature 1..9: note = RNA
  misc_feature 10: note = DNA
  misc_feature 11: note = RNA
  misc_feature 12: note = DNA
  misc_feature 13..18: note = RNA
  misc_feature 19: note = DNA
cggcgggaatctcggccct

SEQ ID NO: 138 - DNA, 19 bp, synthetic construct
  source 1..19: mol_type = other DNA
  misc_feature 1..8: note = RNA
  misc_feature 9: note = DNA
  misc_feature 10: note = RNA
  misc_feature 11: note = DNA
  misc_feature 12..17: note = RNA
  misc_feature 18: note = DNA
  misc_feature 19: note = RNA
ggcgggaatctcggccctg

SEQ ID NO: 139 - DNA, 19 bp, synthetic construct
  source 1..19: mol_type = other DNA
  misc_feature 1..7: note = RNA
  misc_feature 8: note = DNA
  misc_feature 9: note = RNA
  misc_feature 10: note = DNA
  misc_feature 11..16: note = RNA
  misc_feature 17: note = DNA
  misc_feature 18..19: note = RNA
gcgggaatctcggccctgg

SEQ ID NO: 140 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..15: note = RNA
  misc_feature 16: note = DNA
  misc_feature 17..19: note = RNA
cgggaatctcggccctggc

SEQ ID NO: 141 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..14: note = RNA
  misc_feature 15: note = DNA
  misc_feature 16..19: note = RNA
gggaatctcggccctggcc

SEQ ID NO: 142 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..13: note = RNA
  misc_feature 14: note = DNA
  misc_feature 15..19: note = RNA
ggaatctcggccctggccc

SEQ ID NO: 143 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..12: note = RNA
  misc_feature 13: note = DNA
  misc_feature 14..19: note = RNA
gaatctcggccctggcccg

SEQ ID NO: 144 - RNA, 19 nt, synthetic construct
  source 1..19: mol_type = other RNA
gagacgcggcccgccagaa

SEQ ID NO: 145 - RNA, 19 nt, synthetic construct
  source 1..19: mol_type = other RNA
agacgcggcccgccagaag

SEQ ID NO: 146 - RNA, 19 nt, synthetic construct
  source 1..19: mol_type = other RNA
gccagaaggccggcgaaag

SEQ ID NO: 147 - RNA, 19 nt, synthetic construct
  source 1..19: mol_type = other RNA
ccagaaggccggcgaaagc

SEQ ID NO: 148 - RNA, 19 nt, synthetic construct
  source 1..19: mol_type = other RNA
cagaaggccggcgaaagcg

SEQ ID NO: 149 - RNA, 19 nt, synthetic construct
  source 1..19: mol_type = other RNA
agaaggccggcgaaagcgg

SEQ ID NO: 150 - RNA, 19 nt, synthetic construct
  source 1..19: mol_type = other RNA
gaaggccggcgaaagcgga

SEQ ID NO: 151 - RNA, 19 nt, synthetic construct
  source 1..19: mol_type = other RNA
aaggccggcgaaagcggac

SEQ ID NO: 152 - DNA, 19 bp, synthetic construct
  source 1..19: mol_type = other DNA
  misc_feature 1..17: note = RNA
  misc_feature 18: note = DNA
  misc_feature 19: note = RNA
gcgaaagcggaccgccgtc

SEQ ID NO: 153 - DNA, 19 bp, synthetic construct
  source 1..19: mol_type = other DNA
  misc_feature 1..16: note = RNA
  misc_feature 17: note = DNA
  misc_feature 18..19: note = RNA
cgaaagcggaccgccgtca

SEQ ID NO: 154 - DNA, 19 bp, synthetic construct
  source 1..19: mol_type = other DNA
  misc_feature 1..15: note = RNA
  misc_feature 16: note = DNA
  misc_feature 17..19: note = RNA
gaaagcggaccgccgtcac

SEQ ID NO: 155 - DNA, 19 bp, synthetic construct
  source 1..19: mol_type = other DNA
  misc_feature 1..14: note = RNA
  misc_feature 15: note = DNA
  misc_feature 16..19: note = RNA
aaagcggaccgccgtcacc

SEQ ID NO: 156 - DNA, 19 bp, synthetic construct
  source 1..19: mol_type = other DNA
  misc_feature 1..13: note = RNA
  misc_feature 14: note = DNA
  misc_feature 15..19: note = RNA
aagcggaccgccgtcaccg

SEQ ID NO: 157 - DNA, 19 bp, synthetic construct
  source 1..19: mol_type = other DNA
  misc_feature 1..10: note = RNA
  misc_feature 11: note = DNA
  misc_feature 12..18: note = RNA
  misc_feature 19: note = DNA
cggaccgccgtcaccggat

SEQ ID NO: 158 - DNA, 19 bp, synthetic construct
  source 1..19: mol_type = other DNA
  misc_feature 1..9: note = RNA
  misc_feature 10: note = DNA
  misc_feature 11..17: note = RNA
  misc_feature 18: note = DNA
  misc_feature 19: note = RNA
ggaccgccgtcaccggatc

SEQ ID NO: 159 - DNA, 19 bp, synthetic construct
  source 1..19: mol_type = other DNA
  misc_feature 1..8: note = RNA
  misc_feature 9: note = DNA
  misc_feature 10..16: note = RNA
  misc_feature 17: note = DNA
  misc_feature 18..19: note = RNA
gaccgccgtcaccggatcc

SEQ ID NO: 160 - DNA, 19 bp, synthetic construct
  source 1..19: mol_type = other DNA
  misc_feature 1..7: note = RNA
  misc_feature 8: note = DNA
  misc_feature 9..15: note = RNA
  misc_feature 16: note = DNA
  misc_feature 17..19: note = RNA
accgccgtcaccggatccc

SEQ ID NO: 161 - DNA, 19 bp, synthetic construct
  source 1..19: mol_type = other DNA
  misc_feature 1..6: note = RNA
  misc_feature 7: note = DNA
  misc_feature 8..14: note = RNA
  misc_feature 15: note = DNA
  misc_feature 16..19: note = RNA
ccgccgtcaccggatccca

SEQ ID NO: 162 - DNA, 19 bp, synthetic construct
  source 1..19: mol_type = other DNA
  misc_feature 1..5: note = RNA
  misc_feature 6: note = DNA
  misc_feature 7..13: note = RNA
  misc_feature 14: note = DNA
  misc_feature 15..19: note = RNA
cgccgtcaccggatcccag

SEQ ID NO: 163 - DNA, 19 bp, synthetic construct
  source 1..19: mol_type = other DNA
  misc_feature 1..4: note = RNA
  misc_feature 5: note = DNA
  misc_feature 6..12: note = RNA
  misc_feature 13: note = DNA
  misc_feature 14..19: note = RNA
gccgtcaccggatcccaga

SEQ ID NO: 164 - DNA, 19 bp, synthetic construct
  source 1..19: mol_type = other DNA
  misc_feature 1..3: note = RNA
  misc_feature 4: note = DNA
  misc_feature 5..11: note = RNA
  misc_feature 12: note = DNA
  misc_feature 13..19: note = RNA
ccgtcaccggatcccagac

SEQ ID NO: 165 - DNA, 19 bp, synthetic construct
  source 1..19: mol_type = other DNA
  misc_feature 1..2: note = RNA
  misc_feature 3: note = DNA
  misc_feature 4..10: note = RNA
  misc_feature 11: note = DNA
  misc_feature 12..19: note = RNA
cgtcaccggatcccagacc

SEQ ID NO: 166 - DNA, 19 bp, synthetic construct
  source 1..19: mol_type = other DNA
  misc_feature 1: note = RNA
  misc_feature 2: note = DNA
  misc_feature 3..9: note = RNA
  misc_feature 10: note = DNA
  misc_feature 11..19: note = RNA
gtcaccggatcccagaccg

SEQ ID NO: 167 - DNA, 19 bp, synthetic construct
  source 1..19: mol_type = other DNA
  misc_feature 1: note = DNA
  misc_feature 2..8: note = RNA
  misc_feature 9: note = DNA
  misc_feature 10..19: note = RNA
tcaccggatcccagaccgc

SEQ ID NO: 168 - DNA, 19 bp, synthetic construct
  source 1..19: mol_type = other DNA
  misc_feature 1..7: note = RNA
  misc_feature 8: note = DNA
  misc_feature 9..19: note = RNA
caccggatcccagaccgcc

SEQ ID NO: 169 - DNA, 19 bp, synthetic construct
  source 1..19: mol_type = other DNA
  misc_feature 1..6: note = RNA
  misc_feature 7: note = DNA
  misc_feature 8..19: note = RNA
accggatcccagaccgccc

SEQ ID NO: 170 - DNA, 19 bp, synthetic construct
  source 1..19: mol_type = other DNA
  misc_feature 1..5: note = RNA
  misc_feature 6: note = DNA
  misc_feature 7..18: note = RNA
  misc_feature 19: note = DNA
ccggatcccagaccgccct

SEQ ID NO: 171 - DNA, 19 bp, synthetic construct
  source 1..19: mol_type = other DNA
  misc_feature 1..4: note = RNA
  misc_feature 5: note = DNA
  misc_feature 6..17: note = RNA
  misc_feature 18: note = DNA
  misc_feature 19: note = RNA
cggatcccagaccgccctg

SEQ ID NO: 172 - DNA, 19 bp, synthetic construct
  source 1..19: mol_type = other DNA
  misc_feature 1..3: note = RNA
  misc_feature 4: note = DNA
  misc_feature 5..16: note = RNA
  misc_feature 17: note = DNA
  misc_feature 18..19: note = RNA
ggatcccagaccgccctgc

SEQ ID NO: 173 - DNA, 19 bp, synthetic construct
  source 1..19: mol_type = other DNA
  misc_feature 1..2: note = RNA
  misc_feature 3: note = DNA
  misc_feature 4..15: note = RNA
  misc_feature 16: note = DNA
  misc_feature 17..18: note = RNA
  misc_feature 19: note = DNA
gatcccagaccgccctgct

SEQ ID NO: 174 - DNA, 19 bp, synthetic construct
  source 1..19: mol_type = other DNA
  misc_feature 1: note = RNA
  misc_feature 2: note = DNA
  misc_feature 3..14: note = RNA
  misc_feature 15: note = DNA
  misc_feature 16..17: note = RNA
  misc_feature 18: note = DNA
  misc_feature 19: note = RNA
atcccagaccgccctgctc

SEQ ID NO: 175 - DNA, 19 bp, synthetic construct
  source 1..19: mol_type = other DNA
  misc_feature 1: note = DNA
  misc_feature 2..13: note = RNA
  misc_feature 14: note = DNA
  misc_feature 15..16: note = RNA
  misc_feature 17: note = DNA
  misc_feature 18..19: note = RNA
tcccagaccgccctgctcc

SEQ ID NO: 176 - DNA, 19 bp, synthetic construct
  source 1..19: mol_type = other DNA
  misc_feature 1..12: note = RNA
  misc_feature 13: note = DNA
  misc_feature 14..15: note = RNA
  misc_feature 16: note = DNA
  misc_feature 17..18: note = RNA
  misc_feature 19: note = DNA
cccagaccgccctgctcct

SEQ ID NO: 177 - DNA, 19 bp, synthetic construct
  source 1..19: mol_type = other DNA
  misc_feature 1..11: note = RNA
  misc_feature 12: note = DNA
  misc_feature 13..14: note = RNA
  misc_feature 15: note = DNA
  misc_feature 16..17: note = RNA
  misc_feature 18: note = DNA
  misc_feature 19: note = RNA
ccagaccgccctgctcctc

SEQ ID NO: 178 - DNA, 19 bp, synthetic construct
  source 1..19: mol_type = other DNA
  misc_feature 1..10: note = RNA
  misc_feature 11: note = DNA
  misc_feature 12..13: note = RNA
  misc_feature 14: note = DNA
  misc_feature 15..16: note = RNA
  misc_feature 17: note = DNA
  misc_feature 18..19: note = RNA
cagaccgccctgctcctcc

SEQ ID NO: 179 - DNA, 19 bp, synthetic construct
  source 1..19: mol_type = other DNA
  misc_feature 1..9: note = RNA
  misc_feature 10: note = DNA
  misc_feature 11..12: note = RNA
  misc_feature 13: note = DNA
  misc_feature 14..15: note = RNA
  misc_feature 16: note = DNA
  misc_feature 17..19: note = RNA
agaccgccctgctcctccg

SEQ ID NO: 180 - DNA, 19 bp, synthetic construct
  source 1..19: mol_type = other DNA
  misc_feature 1..8: note = RNA
  misc_feature 9: note = DNA
  misc_feature 10..11: note = RNA
  misc_feature 12: note = DNA
  misc_feature 13..14: note = RNA
  misc_feature 15: note = DNA
  misc_feature 16..19: note = RNA
gaccgccctgctcctccga

SEQ ID NO: 181 - DNA, 19 bp, synthetic construct
  source 1..19: mol_type = other DNA
  misc_feature 1..7: note = RNA
  misc_feature 8: note = DNA
  misc_feature 9..10: note = RNA
  misc_feature 11: note = DNA
  misc_feature 12..13: note = RNA
  misc_feature 14: note = DNA
  misc_feature 15..19: note = RNA
accgccctgctcctccgag

SEQ ID NO: 182 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..12: note = RNA
  misc_feature 13..15: note = DNA
  misc_feature 16..19: note = RNA
ctcctccgagcctttgaga

SEQ ID NO: 183 - DNA, 19 bp, synthetic construct
  source 1..19: mol_type = other DNA
  misc_feature 1: note = RNA
  misc_feature 2: note = DNA
  misc_feature 3..9: note = RNA
  misc_feature 10..12: note = DNA
  misc_feature 13..19: note = RNA
ctccgagcctttgagaagg

SEQ ID NO: 184 - DNA, 19 bp, synthetic construct
  source 1..19: mol_type = other DNA
  misc_feature 1: note = RNA
  misc_feature 2..4: note = DNA
  misc_feature 5..12: note = RNA
  misc_feature 13: note = DNA
  misc_feature 14..16: note = RNA
  misc_feature 17..19: note = DNA
ctttgagaaggatcgcttt

SEQ ID NO: 185 - DNA, 19 bp, synthetic construct
  source 1..19: mol_type = other DNA
  misc_feature 1..3: note = DNA
  misc_feature 4..11: note = RNA
  misc_feature 12: note = DNA
  misc_feature 13..15: note = RNA
  misc_feature 16..18: note = DNA
  misc_feature 19: note = RNA
tttgagaaggatcgctttc

SEQ ID NO: 186 - DNA, 19 bp, synthetic construct
  source 1..19: mol_type = other DNA
  misc_feature 1..2: note = DNA
  misc_feature 3..10: note = RNA
  misc_feature 11: note = DNA
  misc_feature 12..14: note = RNA
  misc_feature 15..17: note = DNA
  misc_feature 18..19: note = RNA
ttgagaaggatcgctttcc

SEQ ID NO: 187 - DNA, 19 bp, synthetic construct
  source 1..19: mol_type = other DNA
  misc_feature 1: note = DNA
  misc_feature 2..9: note = RNA
  misc_feature 10: note = DNA
  misc_feature 11..13: note = RNA
  misc_feature 14..16: note = DNA
  misc_feature 17..19: note = RNA
tgagaaggatcgctttcca

SEQ ID NO: 188 - DNA, 19 bp, synthetic construct
  source 1..19: mol_type = other DNA
  misc_feature 1..8: note = RNA
  misc_feature 9: note = DNA
  misc_feature 10..12: note = RNA
  misc_feature 13..15: note = DNA
  misc_feature 16..19: note = RNA
gagaaggatcgctttccag

SEQ ID NO: 189 - DNA, 19 bp, synthetic construct
  source 1..19: mol_type = other DNA
  misc_feature 1..7: note = RNA
  misc_feature 8: note = DNA
  misc_feature 9..11: note = RNA
  misc_feature 12..14: note = DNA
  misc_feature 15..19: note = RNA
agaaggatcgctttccagg

SEQ ID NO: 190 - DNA, 19 bp, synthetic construct
  source 1..19: mol_type = other DNA
  misc_feature 1..6: note = RNA
  misc_feature 7: note = DNA
  misc_feature 8..10: note = RNA
  misc_feature 11..13: note = DNA
  misc_feature 14..19: note = RNA
gaaggatcgctttccaggc

SEQ ID NO: 191 - DNA, 19 bp, synthetic construct
  source 1..19: mol_type = other DNA
  misc_feature 1..5: note = RNA
  misc_feature 6: note = DNA
  misc_feature 7..9: note = RNA
  misc_feature 10..12: note = DNA
  misc_feature 13..19: note = RNA
aaggatcgctttccaggca

SEQ ID NO: 192 - DNA, 19 bp, synthetic construct
  source 1..19: mol_type = other DNA
  misc_feature 1..4: note = RNA
  misc_feature 5: note = DNA
  misc_feature 6..8: note = RNA
  misc_feature 9..11: note = DNA
  misc_feature 12..18: note = RNA
  misc_feature 19: note = DNA
aggatcgctttccaggcat

SEQ ID NO: 193 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8..10: note = DNA
  misc_feature 11..17: note = RNA
  misc_feature 18: note = DNA
  misc_feature 19: note = RNA
ggatcgctttccaggcatc

SEQ ID NO: 194 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7..9: note = DNA
  misc_feature 10..16: note = RNA
  misc_feature 17: note = DNA
  misc_feature 18..19: note = RNA
gatcgctttccaggcatcg

SEQ ID NO: 195 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6..8: note = DNA
  misc_feature 9..15: note = RNA
  misc_feature 16: note = DNA
  misc_feature 17..19: note = RNA
atcgctttccaggcatcgc

SEQ ID NO: 196 - DNA, 19 bp, synthetic construct
  source 1..19: mol_type = other DNA
  misc_feature 1: note = DNA
  misc_feature 2..4: note = RNA
  misc_feature 5..7: note = DNA
  misc_feature 8..14: note = RNA
  misc_feature 15: note = DNA
  misc_feature 16..19: note = RNA
tcgctttccaggcatcgcc

SEQ ID NO: 197 - DNA, 19 bp, synthetic construct
  source 1..19: mol_type = other DNA
  misc_feature 1..3: note = RNA
  misc_feature 4..6: note = DNA
  misc_feature 7..13: note = RNA
  misc_feature 14: note = DNA
  misc_feature 15..19: note = RNA
cgctttccaggcatcgccg

SEQ ID NO: 198 - DNA, 19 bp, synthetic construct
  source 1..19: mol_type = other DNA
  misc_feature 1..2: note = RNA
  misc_feature 3..5: note = DNA
  misc_feature 6..12: note = RNA
  misc_feature 13: note = DNA
  misc_feature 14..19: note = RNA
gctttccaggcatcgccgc

SEQ ID NO: 199 - DNA, 19 bp, synthetic construct
  source 1..19: mol_type = other DNA
  misc_feature 1: note = RNA
  misc_feature 2..4: note = DNA
  misc_feature 5..11: note = RNA
  misc_feature 12: note = DNA
  misc_feature 13..19: note = RNA
ctttccaggcatcgccgcc

SEQ ID NO: 200 - DNA, 19 bp, synthetic construct
  source 1..19: mol_type = other DNA
  misc_feature 1..3: note = DNA
  misc_feature 4..10: note = RNA
  misc_feature 11: note = DNA
  misc_feature 12..19: note = RNA
tttccaggcatcgccgccc

SEQ ID NO: 201 - DNA, 19 bp, synthetic construct
  source 1..19: mol_type = other DNA
  misc_feature 1..2: note = DNA
  misc_feature 3..9: note = RNA
  misc_feature 10: note = DNA
  misc_feature 11..19: note = RNA
ttccaggcatcgccgcccg

SEQ ID NO: 202 - DNA, 19 bp, synthetic construct
  source 1..19: mol_type = other DNA
  misc_feature 1..11: note = RNA
  misc_feature 12: note = DNA
  misc_feature 13..19: note = RNA
ccgggaggagctggccaga

SEQ ID NO: 203 - DNA, 19 bp, synthetic construct
  source 1..19: mol_type = other DNA
  misc_feature 1..10: note = RNA
  misc_feature 11: note = DNA
  misc_feature 12..19: note = RNA
cgggaggagctggccagag

SEQ ID NO: 204 - DNA, 19 bp, synthetic construct
  source 1..19: mol_type = other DNA
  misc_feature 1..9: note = RNA
  misc_feature 10: note = DNA
  misc_feature 11..19: note = RNA
gggaggagctggccagaga

SEQ ID NO: 205 - DNA, 19 bp, synthetic construct
  source 1..19: mol_type = other DNA
  misc_feature 1..8: note = RNA
  misc_feature 9: note = DNA
  misc_feature 10..19: note = RNA
ggaggagctggccagagag

SEQ ID NO: 206 - DNA, 19 bp, synthetic construct
  source 1..19: mol_type = other DNA
  misc_feature 1..7: note = RNA
  misc_feature 8: note = DNA
  misc_feature 9..19: note = RNA
gaggagctggccagagaga

SEQ ID NO: 207 - DNA, 19 bp, synthetic construct
  source 1..19: mol_type = other DNA
  misc_feature 1..6: note = RNA
  misc_feature 7: note = DNA
  misc_feature 8..19: note = RNA
aggagctggccagagagac

SEQ ID NO: 208 - DNA, 19 bp, synthetic construct
  source 1..19: mol_type = other DNA
  misc_feature 1..5: note = RNA
  misc_feature 6: note = DNA
  misc_feature 7..19: note = RNA
ggagctggccagagagacg

SEQ ID NO: 209 - DNA, 19 bp, synthetic construct
  source 1..19: mol_type = other DNA
  misc_feature 1..4: note = RNA
  misc_feature 5: note = DNA
  misc_feature 6..19: note = RNA
gagctggccagagagacgg

SEQ ID NO: 210 - DNA, 19 bp, synthetic construct
  source 1..19: mol_type = other DNA
  misc_feature 1..3: note = RNA
  misc_feature 4: note = DNA
  misc_feature 5..19: note = RNA
agctggccagagagacggg

SEQ ID NO: 211 - DNA, 19 bp, synthetic construct
  source 1..19: mol_type = other DNA
  misc_feature 1..2: note = RNA
  misc_feature 3: note = DNA
  misc_feature 4..19: note = RNA
gctggccagagagacgggc

SEQ ID NO: 212 - DNA, 19 bp, synthetic construct
  source 1..19: mol_type = other DNA
  misc_feature 1..16: note = RNA
  misc_feature 17: note = DNA
  misc_feature 18..19: note = RNA
gccagagagacgggcctcc

SEQ ID NO: 213 - DNA, 19 bp, synthetic construct
  source 1..19: mol_type = other DNA
  misc_feature 1..15: note = RNA
  misc_feature 16: note = DNA
  misc_feature 17..19: note = RNA
ccagagagacgggcctccc

SEQ ID NO: 214 - DNA, 19 bp, synthetic construct
  source 1..19: mol_type = other DNA
  misc_feature 1..14: note = RNA
  misc_feature 15: note = DNA
  misc_feature 16..19: note = RNA
cagagagacgggcctcccg

SEQ ID NO: 215 - DNA, 19 bp, synthetic construct
  source 1..19: mol_type = other DNA
  misc_feature 1..13: note = RNA
  misc_feature 14: note = DNA
  misc_feature 15..19: note = RNA
agagagacgggcctcccgg

SEQ ID NO: 216 - DNA, 19 bp, synthetic construct
  source 1..19: mol_type = other DNA
  misc_feature 1..4: note = RNA
  misc_feature 5: note = DNA
  misc_feature 6..12: note = RNA
  misc_feature 13: note = DNA
  misc_feature 14..19: note = RNA
ggcctcccggagtccagga

SEQ ID NO: 217 - DNA, 19 bp, synthetic construct
  source 1..19: mol_type = other DNA
  misc_feature 1..3: note = RNA
  misc_feature 4: note = DNA
  misc_feature 5..11: note = RNA
  misc_feature 12: note = DNA
  misc_feature 13..18: note = RNA
  misc_feature 19: note = DNA
gcctcccggagtccaggat

SEQ ID NO: 218 - DNA, 19 bp, synthetic construct
  source 1..19: mol_type = other DNA
  misc_feature 1..2: note = RNA
  misc_feature 3: note = DNA
  misc_feature 4..10: note = RNA
  misc_feature 11: note = DNA
  misc_feature 12..17: note = RNA
  misc_feature 18..19: note = DNA
cctcccggagtccaggatt

SEQ ID NO: 219 - DNA, 19 bp, synthetic construct
  source 1..19: mol_type = other DNA
  misc_feature 1: note = RNA
  misc_feature 2: note = DNA
  misc_feature 3..9: note = RNA
  misc_feature 10: note = DNA
  misc_feature 11..16: note = RNA
  misc_feature 17..18: note = DNA
  misc_feature 19: note = RNA
ctcccggagtccaggattc

SEQ ID NO: 220 - DNA, 19 bp, synthetic construct
  source 1..19: mol_type = other DNA
  misc_feature 1: note = DNA
  misc_feature 2..8: note = RNA
  misc_feature 9: note = DNA
  misc_feature 10..15: note = RNA
  misc_feature 16..17: note = DNA
  misc_feature 18..19: note = RNA
tcccggagtccaggattca

SEQ ID NO: 221 - DNA, 19 bp, synthetic construct
  source 1..19: mol_type = other DNA
  misc_feature 1..7: note = RNA
  misc_feature 8: note = DNA
  misc_feature 9..14: note = RNA
  misc_feature 15..16: note = DNA
  misc_feature 17..19: note = RNA
cccggagtccaggattcag

SEQ ID NO: 222 - DNA, 19 bp, synthetic construct
  source 1..19: mol_type = other DNA
  misc_feature 1..6: note = RNA
  misc_feature 7: note = DNA
  misc_feature 8..13: note = RNA
  misc_feature 14..15: note = DNA
  misc_feature 16..19: note = RNA
ccggagtccaggattcaga

SEQ ID NO: 223 - DNA, 19 bp, synthetic construct
  source 1..19: mol_type = other DNA
  misc_feature 1..5: note = RNA
  misc_feature 6: note = DNA
  misc_feature 7..12: note = RNA
  misc_feature 13..14: note = DNA
  misc_feature 15..18: note = RNA
  misc_feature 19: note = DNA
cggagtccaggattcagat

SEQ ID NO: 224 - DNA, 19 bp, synthetic construct
  source 1..19: mol_type = other DNA
  misc_feature 1..4: note = RNA
  misc_feature 5: note = DNA
  misc_feature 6..11: note = RNA
  misc_feature 12..13: note = DNA
  misc_feature 14..17: note = RNA
  misc_feature 18: note = DNA
  misc_feature 19: note = RNA
ggagtccaggattcagatc

SEQ ID NO: 225 - DNA, 19 bp, synthetic construct
  source 1..19: mol_type = other DNA
  misc_feature 1..3: note = RNA
  misc_feature 4: note = DNA
  misc_feature 5..10: note = RNA
  misc_feature 11..12: note = DNA
  misc_feature 13..16: note = RNA
  misc_feature 17: note = DNA
  misc_feature 18: note = RNA
  misc_feature 19: note = DNA
gagtccaggattcagatct

SEQ ID NO: 226 - DNA, 19 bp, synthetic construct
  source 1..19: mol_type = other DNA
  misc_feature 1..2: note = RNA
  misc_feature 3: note = DNA
  misc_feature 4..9: note = RNA
  misc_feature 10..11: note = DNA
  misc_feature 12..15: note = RNA
  misc_feature 16: note = DNA
  misc_feature 17: note = RNA
  misc_feature 18: note = DNA
  misc_feature 19: note = RNA
agtccaggattcagatctg

SEQ ID NO: 227 - DNA, 19 bp, synthetic construct
  source 1..19: mol_type = other DNA
  misc_feature 1..5: note = RNA
  misc_feature 6..7: note = DNA
  misc_feature 8..11: note = RNA
  misc_feature 12: note = DNA
  misc_feature 13: note = RNA
  misc_feature 14: note = DNA
  misc_feature 15..16: note = RNA
  misc_feature 17..19: note = DNA
caggattcagatctggttt

SEQ ID NO: 228 - DNA, 19 bp, synthetic construct
  source 1..19: mol_type = other DNA
  misc_feature 1..4: note = RNA
  misc_feature 5..6: note = DNA
  misc_feature 7..10: note = RNA
  misc_feature 11: note = DNA
  misc_feature 12: note = RNA
  misc_feature 13: note = DNA
  misc_feature 14..15: note = RNA
  misc_feature 16..18: note = DNA
  misc_feature 19: note = RNA
aggattcagatctggtttc

SEQ ID NO: 229 - DNA, 19 bp, synthetic construct
  source 1..19: mol_type = other DNA
  misc_feature 1..3: note = RNA
  misc_feature 4..5: note = DNA
  misc_feature 6..9: note = RNA
  misc_feature 10: note = DNA
  misc_feature 11: note = RNA
  misc_feature 12: note = DNA
  misc_feature 13..14: note = RNA
  misc_feature 15..17: note = DNA
  misc_feature 18..19: note = RNA
ggattcagatctggtttca

SEQ ID NO: 230 - DNA, 19 bp, synthetic construct
  source 1..19: mol_type = other DNA
  misc_feature 1..2: note = RNA
  misc_feature 3..4: note = DNA
  misc_feature 5..8: note = RNA
  misc_feature 9: note = DNA
  misc_feature 10: note = RNA
  misc_feature 11: note = DNA
  misc_feature 12..13: note = RNA
  misc_feature 14..16: note = DNA
  misc_feature 17..19: note = RNA
gattcagatctggtttcag

SEQ ID NO: 231 - DNA, 19 bp, synthetic construct
  source 1..19: mol_type = other DNA
  misc_feature 1: note = RNA
  misc_feature 2..3: note = DNA
  misc_feature 4..7: note = RNA
  misc_feature 8: note = DNA
  misc_feature 9: note = RNA
  misc_feature 10: note = DNA
  misc_feature 11..12: note = RNA
  misc_feature 13..15: note = DNA
  misc_feature 16..19: note = RNA
attcagatctggtttcaga

SEQ ID NO: 232 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5..7: note = DNA
  misc_feature 8..12: note = RNA
  misc_feature 13: note = DNA
  misc_feature 14..19: note = RNA
ctggtttcagaatcgaagg

SEQ ID NO: 233 - DNA, 19 bp, synthetic construct
  source 1..19: mol_type = other DNA
  misc_feature 1: note = DNA
  misc_feature 2..3: note = RNA
  misc_feature 4..6: note = DNA
  misc_feature 7..11: note = RNA
  misc_feature 12: note = DNA
  misc_feature 13..19: note = RNA
tggtttcagaatcgaaggg

SEQ ID NO: 234 - DNA, 19 bp, synthetic construct
  source 1..19: mol_type = other DNA
  misc_feature 1..2: note = RNA
  misc_feature 3..5: note = DNA
  misc_feature 6..10: note = RNA
  misc_feature 11: note = DNA
  misc_feature 12..19: note = RNA
ggtttcagaatcgaagggc

SEQ ID NO: 235 - DNA, 19 bp, synthetic construct
  source 1..19: mol_type = other DNA
  misc_feature 1: note = RNA
  misc_feature 2..4: note = DNA
  misc_feature 5..9: note = RNA
  misc_feature 10: note = DNA
  misc_feature 11..19: note = RNA
gtttcagaatcgaagggcc

SEQ ID NO: 236 - DNA, 19 bp, synthetic construct
  source 1..19: mol_type = other DNA
  misc_feature 1..3: note = DNA
  misc_feature 4..8: note = RNA
  misc_feature 9: note = DNA
  misc_feature 10..19: note = RNA
tttcagaatcgaagggcca

SEQ ID NO: 237 - DNA, 19 bp, synthetic construct
  source 1..19: mol_type = other DNA
  misc_feature 1..2: note = DNA
  misc_feature 3..7: note = RNA
  misc_feature 8: note = DNA
  misc_feature 9..19: note = RNA
ttcagaatcgaagggccag

SEQ ID NO: 238 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..19: note = RNA
tcagaatcgaagggccagg

SEQ ID NO: 239 - DNA, 19 bp, synthetic construct
  source 1..19: mol_type = other DNA
  misc_feature 1..5: note = RNA
  misc_feature 6: note = DNA
  misc_feature 7..19: note = RNA
cagaatcgaagggccaggc

SEQ ID NO: 240 - DNA, 19 bp, synthetic construct
  source 1..19: mol_type = other DNA
  misc_feature 1..4: note = RNA
  misc_feature 5: note = DNA
  misc_feature 6..19: note = RNA
agaatcgaagggccaggca

SEQ ID NO: 241 - DNA, 19 bp, synthetic construct
  source 1..19: mol_type = other DNA
  misc_feature 1..3: note = RNA
  misc_feature 4: note = DNA
  misc_feature 5..19: note = RNA
gaatcgaagggccaggcac

SEQ ID NO: 242 - DNA, 19 bp, synthetic construct
  source 1..19: mol_type = other DNA
  misc_feature 1..2: note = RNA
  misc_feature 3: note = DNA
  misc_feature 4..19: note = RNA
aatcgaagggccaggcacc

SEQ ID NO: 243 - DNA, 19 bp, synthetic construct
  source 1..19: mol_type = other DNA
  misc_feature 1: note = RNA
  misc_feature 2: note = DNA
  misc_feature 3..19: note = RNA
atcgaagggccaggcaccc

SEQ ID NO: 244 - DNA, 19 bp, synthetic construct
  source 1..19: mol_type = other DNA
  misc_feature 1: note = DNA
  misc_feature 2..19: note = RNA
tcgaagggccaggcacccg

SEQ ID NO: 245 - DNA, 19 bp, synthetic construct
  source 1..19: mol_type = other DNA
  misc_feature 1..4: note = RNA
  misc_feature 5: note = DNA
  misc_feature 6..10: note = RNA
  misc_feature 11: note = DNA
  misc_feature 12..13: note = RNA
  misc_feature 14: note = DNA
  misc_feature 15..17: note = RNA
  misc_feature 18: note = DNA
  misc_feature 19: note = RNA
ggggtcaccctgctccctc

SEQ ID NO: 246 - DNA, 19 bp, synthetic construct
  source 1..19: mol_type = other DNA
  misc_feature 1..3: note = RNA
  misc_feature 4: note = DNA
  misc_feature 5..9: note = RNA
  misc_feature 10: note = DNA
  misc_feature 11..12: note = RNA
  misc_feature 13: note = DNA
  misc_feature 14..16: note = RNA
  misc_feature 17: note = DNA
  misc_feature 18..19: note = RNA
gggtcaccctgctccctcg

SEQ ID NO: 247 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9: note = DNA
  misc_feature 10..11: note = RNA
  misc_feature 12: note = DNA
  misc_feature 13..15: note = RNA
  misc_feature 16: note = DNA
  misc_feature 17..18: note = RNA
  misc_feature 19: note = DNA
ggtcaccctgctccctcgt

SEQ ID NO: 248 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8: note = DNA
  misc_feature 9..10: note = RNA
  misc_feature 11: note = DNA
  misc_feature 12..14: note = RNA
  misc_feature 15: note = DNA
  misc_feature 16..17: note = RNA
  misc_feature 18: note = DNA
  misc_feature 19: note = RNA
gtcaccctgctccctcgtg

SEQ ID NO: 249 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..9: note = RNA
  misc_feature 10: note = DNA
  misc_feature 11..13: note = RNA
  misc_feature 14: note = DNA
  misc_feature 15..16: note = RNA
  misc_feature 17: note = DNA
  misc_feature 18..19: note = RNA
tcaccctgctccctcgtgg

SEQ ID NO: 250 - DNA, 19 bp, synthetic construct
  source 1..19: mol_type = other DNA
  misc_feature 1..5: note = RNA
  misc_feature 6: note = DNA
  misc_feature 7..8: note = RNA
  misc_feature 9: note = DNA
  misc_feature 10..12: note = RNA
  misc_feature 13: note = DNA
  misc_feature 14..15: note = RNA
  misc_feature 16: note = DNA
  misc_feature 17..19: note = RNA
caccctgctccctcgtggg

SEQ ID NO: 251 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..10: note = RNA
  misc_feature 11: note = DNA
  misc_feature 12..13: note = RNA
  misc_feature 14: note = DNA
  misc_feature 15..17: note = RNA
  misc_feature 18: note = DNA
  misc_feature 19: note = RNA
ccctgctccctcgtgggtc

SEQ ID NO: 252 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..9: note = RNA
  misc_feature 10: note = DNA
  misc_feature 11..12: note = RNA
  misc_feature 13: note = DNA
  misc_feature 14..16: note = RNA
  misc_feature 17: note = DNA
  misc_feature 18..19: note = RNA
cctgctccctcgtgggtcg

SEQ ID NO: 253 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..8: note = RNA
  misc_feature 9: note = DNA
  misc_feature 10..11: note = RNA
  misc_feature 12: note = DNA
  misc_feature 13..15: note = RNA
  misc_feature 16: note = DNA
  misc_feature 17..19: note = RNA
ctgctccctcgtgggtcgc

SEQ ID NO: 254 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..7: note = RNA
  misc_feature 8: note = DNA
  misc_feature 9..10: note = RNA
  misc_feature 11: note = DNA
  misc_feature 12..14: note = RNA
  misc_feature 15: note = DNA
  misc_feature 16..19: note = RNA
tgctccctcgtgggtcgcc

SEQ ID NO: 255 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..9: note = RNA
  misc_feature 10: note = DNA
  misc_feature 11..13: note = RNA
  misc_feature 14: note = DNA
  misc_feature 15..18: note = RNA
  misc_feature 19: note = DNA
gctccctcgtgggtcgcct

SEQ ID NO: 256 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..8: note = RNA
  misc_feature 9: note = DNA
  misc_feature 10..12: note = RNA
  misc_feature 13: note = DNA
  misc_feature 14..17: note = RNA
  misc_feature 18..19: note = DNA
ctccctcgtgggtcgcctt

SEQ ID NO: 257 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..7: note = RNA
  misc_feature 8: note = DNA
  misc_feature 9..11: note = RNA
  misc_feature 12: note = DNA
  misc_feature 13..16: note = RNA
  misc_feature 17..18: note = DNA
  misc_feature 19: note = RNA
tccctcgtgggtcgccttc

SEQ ID NO: 258 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..10: note = RNA
  misc_feature 11: note = DNA
  misc_feature 12..15: note = RNA
  misc_feature 16..17: note = DNA
  misc_feature 18..19: note = RNA
ccctcgtgggtcgccttcg

SEQ ID NO: 259 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..9: note = RNA
  misc_feature 10: note = DNA
  misc_feature 11..14: note = RNA
  misc_feature 15..16: note = DNA
  misc_feature 17..19: note = RNA
cctcgtgggtcgccttcgc

SEQ ID NO: 260 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..8: note = RNA
  misc_feature 9: note = DNA
  misc_feature 10..13: note = RNA
  misc_feature 14..15: note = DNA
  misc_feature 16..19: note = RNA
ctcgtgggtcgccttcgcc

SEQ ID NO: 261 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..7: note = RNA
  misc_feature 8: note = DNA
  misc_feature 9..12: note = RNA
  misc_feature 13..14: note = DNA
  misc_feature 15..19: note = RNA
tcgtgggtcgccttcgccc

SEQ ID NO: 262 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9..10: note = DNA
  misc_feature 11..19: note = RNA
gggtcgccttcgcccacac

SEQ ID NO: 263 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8..9: note = DNA
  misc_feature 10..19: note = RNA
ggtcgccttcgcccacacc

SEQ ID NO: 264 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7..8: note = DNA
  misc_feature 9..19: note = RNA
gtcgccttcgcccacaccg

SEQ ID NO: 265 - DNA, 19 bp, synthetic construct
  source 1..19: mol_type = other DNA
  misc_feature 1: note = DNA
  misc_feature 2..5: note = RNA
  misc_feature 6..7: note = DNA
  misc_feature 8..19: note = RNA
tcgccttcgcccacaccgg

SEQ ID NO: 266 - DNA, 19 bp, synthetic construct
  source 1..19: mol_type = other DNA
  misc_feature 1..12: note = RNA
  misc_feature 13: note = DNA
  misc_feature 14..19: note = RNA
cacaccggcgcgtggggaa

SEQ ID NO: 267 - DNA, 19 bp, synthetic construct
  source 1..19: mol_type = other DNA
  misc_feature 1..11: note = RNA
  misc_feature 12: note = DNA
  misc_feature 13..19: note = RNA
acaccggcgcgtggggaac

SEQ ID NO: 268 - DNA, 19 bp, synthetic construct
  source 1..19: mol_type = other DNA
  misc_feature 1..4: note = RNA
  misc_feature 5: note = DNA
  misc_feature 6..17: note = RNA
  misc_feature 18..19: note = DNA
cgcgtggggaacggggctt

SEQ ID NO: 269 - DNA, 19 bp, synthetic construct
  source 1..19: mol_type = other DNA
  misc_feature 1..3: note = RNA
  misc_feature 4: note = DNA
  misc_feature 5..16: note = RNA
  misc_feature 17..18: note = DNA
  misc_feature 19: note = RNA
gcgtggggaacggggcttc

SEQ ID NO: 270 - DNA, 19 bp, synthetic construct
  source 1..19: mol_type = other DNA
  misc_feature 1..3: note = RNA
  misc_feature 4..5: note = DNA
  misc_feature 6..18: note = RNA
  misc_feature 19: note = DNA
ggcttcccgcaccccacgt

SEQ ID NO: 271 - DNA, 19 bp, synthetic construct
  source 1..19: mol_type = other DNA
  misc_feature 1..2: note = RNA
  misc_feature 3..4: note = DNA
  misc_feature 5..17: note = RNA
  misc_feature 18: note = DNA
  misc_feature 19: note = RNA
gcttcccgcaccccacgtg

SEQ ID NO: 272 - DNA, 19 bp, synthetic construct
  source 1..19: mol_type = other DNA
  misc_feature 1..2: note = DNA
  misc_feature 3..4: note = RNA
  misc_feature 5: note = DNA
  misc_feature 6..19: note = RNA
ttcgtgagccaggcagcga

SEQ ID NO: 273 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..19: note = RNA
tcgtgagccaggcagcgag

SEQ ID NO: 274 - DNA, 19 bp, synthetic construct
  source 1..19: mol_type = other DNA
  misc_feature 1..2: note = RNA
  misc_feature 3: note = DNA
  misc_feature 4..19: note = RNA
cgtgagccaggcagcgagg

SEQ ID NO: 275 - DNA, 19 bp, synthetic construct
  source 1..19: mol_type = other DNA
  misc_feature 1: note = RNA
  misc_feature 2: note = DNA
  misc_feature 3..19: note = RNA
gtgagccaggcagcgaggg

SEQ ID NO: 276 - DNA, 19 bp, synthetic construct
  source 1..19: mol_type = other DNA
  misc_feature 1..15: note = RNA
  misc_feature 16: note = DNA
  misc_feature 17: note = RNA
  misc_feature 18: note = DNA
  misc_feature 19: note = RNA
cgccggcagaggggatctc

SEQ ID NO: 277 - DNA, 19 bp, synthetic construct
  source 1..19: mol_type = other DNA
  misc_feature 1..14: note = RNA
  misc_feature 15: note = DNA
  misc_feature 16: note = RNA
  misc_feature 17: note = DNA
  misc_feature 18..19: note = RNA
gccggcagaggggatctcc

SEQ ID NO: 278 - DNA, 19 bp, synthetic construct
  source 1..19: mol_type = other DNA
  misc_feature 1..13: note = RNA
  misc_feature 14: note = DNA
  misc_feature 15: note = RNA
  misc_feature 16: note = DNA
  misc_feature 17..19: note = RNA
ccggcagaggggatctccc

SEQ ID NO: 279 - DNA, 19 bp, synthetic construct
  source 1..19: mol_type = other DNA
  misc_feature 1..12: note = RNA
  misc_feature 13: note = DNA
  misc_feature 14: note = RNA
  misc_feature 15: note = DNA
  misc_feature 16..19: note = RNA
cggcagaggggatctccca

SEQ ID NO: 280 - DNA, 19 bp, synthetic construct
  source 1..19: mol_type = other DNA
  misc_feature 1..11: note = RNA
  misc_feature 12: note = DNA
  misc_feature 13: note = RNA
  misc_feature 14: note = DNA
  misc_feature 15..19: note = RNA
ggcagaggggatctcccaa

SEQ ID NO: 281 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..13: note = RNA
  misc_feature 14: note = DNA
  misc_feature 15..19: note = RNA
ggatctcccaacctgcccc

SEQ ID NO: 282 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..12: note = RNA
  misc_feature 13: note = DNA
  misc_feature 14..19: note = RNA
gatctcccaacctgccccg

SEQ ID NO: 283 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..11: note = RNA
  misc_feature 12: note = DNA
  misc_feature 13..19: note = RNA
atctcccaacctgccccgg

SEQ ID NO: 284 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..10: note = RNA
  misc_feature 11: note = DNA
  misc_feature 12..19: note = RNA
tctcccaacctgccccggc

SEQ ID NO: 285 - DNA, 19 bp, synthetic construct
  source 1..19: mol_type = other DNA
  misc_feature 1..8: note = RNA
  misc_feature 9..11: note = DNA
  misc_feature 12..15: note = RNA
  misc_feature 16: note = DNA
  misc_feature 17..19: note = RNA
cgcggggatttcgcctacg

SEQ ID NO: 286 - DNA, 19 bp, synthetic construct
  source 1..19: mol_type = other DNA
  misc_feature 1..7: note = RNA
  misc_feature 8..10: note = DNA
  misc_feature 11..14: note = RNA
  misc_feature 15: note = DNA
  misc_feature 16..19: note = RNA
gcggggatttcgcctacgc

SEQ ID NO: 287 - DNA, 19 bp, synthetic construct
  source 1..19: mol_type = other DNA
  misc_feature 1..6: note = RNA
  misc_feature 7..9: note = DNA
  misc_feature 10..13: note = RNA
  misc_feature 14: note = DNA
  misc_feature 15..19: note = RNA
cggggatttcgcctacgcc

SEQ ID NO: 288 - DNA, 19 bp, synthetic construct
  source 1..19: mol_type = other DNA
  misc_feature 1..5: note = RNA
  misc_feature 6..8: note = DNA
  misc_feature 9..12: note = RNA
  misc_feature 13: note = DNA
  misc_feature 14..19: note = RNA
ggggatttcgcctacgccg

SEQ ID NO: 289 - DNA, 19 bp, synthetic construct
  source 1..19: mol_type = other DNA
  misc_feature 1..4: note = RNA
  misc_feature 5..7: note = DNA
  misc_feature 8..11: note = RNA
  misc_feature 12: note = DNA
  misc_feature 13..19: note = RNA
gggatttcgcctacgccgc

SEQ ID NO: 290 - DNA, 19 bp, synthetic construct
  source 1..19: mol_type = other DNA
  misc_feature 1..3: note = RNA
  misc_feature 4..6: note = DNA
  misc_feature 7..10: note = RNA
  misc_feature 11: note = DNA
  misc_feature 12..19: note = RNA
ggatttcgcctacgccgcc

SEQ ID NO: 291 - DNA, 19 bp, synthetic construct
  source 1..19: mol_type = other DNA
  misc_feature 1..2: note = RNA
  misc_feature 3..5: note = DNA
  misc_feature 6..9: note = RNA
  misc_feature 10: note = DNA
  misc_feature 11..19: note = RNA
gatttcgcctacgccgccc

SEQ ID NO: 292 - DNA, 19 bp, synthetic construct
  source 1..19: mol_type = other DNA
  misc_feature 1: note = RNA
  misc_feature 2..4: note = DNA
  misc_feature 5..8: note = RNA
  misc_feature 9: note = DNA
  misc_feature 10..19: note = RNA
atttcgcctacgccgcccc

SEQ ID NO: 293 - DNA, 19 bp, synthetic construct
  source 1..19: mol_type = other DNA
  misc_feature 1..3: note = DNA
  misc_feature 4..7: note = RNA
  misc_feature 8: note = DNA
  misc_feature 9..19: note = RNA
tttcgcctacgccgccccg

SEQ ID NO: 294 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..16: note = RNA
  misc_feature 17: note = DNA
  misc_feature 18..19: note = RNA
gggcgctctcccaccctca

SEQ ID NO: 295 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..15: note = RNA
  misc_feature 16: note = DNA
  misc_feature 17..19: note = RNA
ggcgctctcccaccctcag

SEQ ID NO: 296 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..14: note = RNA
  misc_feature 15: note = DNA
  misc_feature 16..19: note = RNA
gcgctctcccaccctcagg

SEQ ID NO: 297 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..13: note = RNA
  misc_feature 14: note = DNA
  misc_feature 15..19: note = RNA
cgctctcccaccctcaggc

SEQ ID NO: 298 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..12: note = RNA
  misc_feature 13: note = DNA
  misc_feature 14..18: note = RNA
  misc_feature 19: note = DNA
gctctcccaccctcaggct

SEQ ID NO: 299 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..11: note = RNA
  misc_feature 12: note = DNA
  misc_feature 13..17: note = RNA
  misc_feature 18: note = DNA
  misc_feature 19: note = RNA
ctctcccaccctcaggctc

SEQ ID NO: 300 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..10: note = RNA
  misc_feature 11: note = DNA
  misc_feature 12..16: note = RNA
  misc_feature 17: note = DNA
  misc_feature 18..19: note = RNA
tctcccaccctcaggctcc

SEQ ID NO: 301 - DNA, 19 bp, synthetic construct
  source 1..19: mol_type = other DNA
  misc_feature 1: note = RNA
  misc_feature 2: note = DNA
  misc_feature 3..9: note = RNA
  misc_feature 10: note = DNA
  misc_feature 11..15: note = RNA
  misc_feature 16: note = DNA
  misc_feature 17..18: note = RNA
  misc_feature 19: note = DNA
ctcccaccctcaggctcct

SEQ ID NO: 302 - DNA, 19 bp, synthetic construct
  source 1..19: mol_type = other DNA
  misc_feature 1: note = DNA
  misc_feature 2..8: note = RNA
  misc_feature 9: note = DNA
  misc_feature 10..14: note = RNA
  misc_feature 15: note = DNA
  misc_feature 16..17: note = RNA
  misc_feature 18: note = DNA
  misc_feature 19: note = RNA
tcccaccctcaggctcctc

SEQ ID NO: 303 - DNA, 19 bp, synthetic construct
  source 1..19: mol_type = other DNA
  misc_feature 1..7: note = RNA
  misc_feature 8: note = DNA
  misc_feature 9..13: note = RNA
  misc_feature 14: note = DNA
  misc_feature 15..16: note = RNA
  misc_feature 17: note = DNA
  misc_feature 18..19: note = RNA
cccaccctcaggctcctcg

SEQ ID NO: 304 - DNA, 19 bp, synthetic construct
  source 1..19: mol_type = other DNA
  misc_feature 1..6: note = RNA
  misc_feature 7: note = DNA
  misc_feature 8..12: note = RNA
  misc_feature 13: note = DNA
  misc_feature 14..15: note = RNA
  misc_feature 16: note = DNA
  misc_feature 17..19: note = RNA
ccaccctcaggctcctcgg

SEQ ID NO: 305 - DNA, 19 bp, synthetic construct
  source 1..19: mol_type = other DNA
  misc_feature 1..5: note = RNA
  misc_feature 6: note = DNA
  misc_feature 7..11: note = RNA
  misc_feature 12: note = DNA
  misc_feature 13..14: note = RNA
  misc_feature 15: note = DNA
  misc_feature 16..18: note = RNA
  misc_feature 19: note = DNA
caccctcaggctcctcggt

SEQ ID NO: 306 - DNA, 19 bp, synthetic construct
  source 1..19: mol_type = other DNA
  misc_feature 1..4: note = RNA
  misc_feature 5: note = DNA
  misc_feature 6..10: note = RNA
  misc_feature 11: note = DNA
  misc_feature 12..13: note = RNA
  misc_feature 14: note = DNA
  misc_feature 15..17: note = RNA
  misc_feature 18: note = DNA
  misc_feature 19: note = RNA
accctcaggctcctcggtg

SEQ ID NO: 307 - DNA, 19 bp, synthetic construct
  source 1..19: mol_type = other DNA
  misc_feature 1..3: note = RNA
  misc_feature 4: note = DNA
  misc_feature 5..9: note = RNA
  misc_feature 10: note = DNA
  misc_feature 11..12: note = RNA
  misc_feature 13: note = DNA
  misc_feature 14..16: note = RNA
  misc_feature 17: note = DNA
  misc_feature 18..19: note = RNA
ccctcaggctcctcggtgg

SEQ ID NO: 308 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9: note = DNA
  misc_feature 10..11: note = RNA
  misc_feature 12: note = DNA
  misc_feature 13..15: note = RNA
  misc_feature 16: note = DNA
  misc_feature 17..19: note = RNA
cctcaggctcctcggtggc

SEQ ID NO: 309 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8: note = DNA
  misc_feature 9..10: note = RNA
  misc_feature 11: note = DNA
  misc_feature 12..14: note = RNA
  misc_feature 15: note = DNA
  misc_feature 16..19: note = RNA
ctcaggctcctcggtggcc

SEQ ID NO: 310 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..8: note = RNA
  misc_feature 9: note = DNA
  misc_feature 10..13: note = RNA
  misc_feature 14: note = DNA
  misc_feature 15..19: note = RNA
ctcctcggtggcctccgca

SEQ ID NO: 311 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..7: note = RNA
  misc_feature 8: note = DNA
  misc_feature 9..12: note = RNA
  misc_feature 13: note = DNA
  misc_feature 14..19: note = RNA
tcctcggtggcctccgcac

SEQ ID NO: 312 - DNA, 19 bp, synthetic construct
  source 1..19: mol_type = other DNA
  misc_feature 1..3: note = RNA
  misc_feature 4: note = DNA
  misc_feature 5..19: note = RNA
gcctccgcacccgggcaaa

SEQ ID NO: 313 - DNA, 19 bp, synthetic construct
  source 1..19: mol_type = other DNA
  misc_feature 1..2: note = RNA
  misc_feature 3: note = DNA
  misc_feature 4..19: note = RNA
cctccgcacccgggcaaaa

SEQ ID NO: 314 - DNA, 19 bp, synthetic construct
  source 1..19: mol_type = other DNA
  misc_feature 1: note = RNA
  misc_feature 2: note = DNA
  misc_feature 3..19: note = RNA
ctccgcacccgggcaaaag

SEQ ID NO: 315 - DNA, 19 bp, synthetic construct
  source 1..19: mol_type = other DNA
  misc_feature 1: note = DNA
  misc_feature 2..19: note = RNA
tccgcacccgggcaaaagc

SEQ ID NO: 316 - RNA, 19 nt, synthetic construct
  source 1..19: mol_type = other RNA
ccgcacccgggcaaaagcc

SEQ ID NO: 317 - RNA, 19 nt, synthetic construct
  source 1..19: mol_type = other RNA
cgcacccgggcaaaagccg

SEQ ID NO: 318 - RNA, 19 nt, synthetic construct
  source 1..19: mol_type = other RNA
cgggcaaaagccgggagga

SEQ ID NO: 319 - RNA, 19 nt, synthetic construct
  source 1..19: mol_type = other RNA
gggcaaaagccgggaggac

SEQ ID NO: 320 - RNA, 19 nt, synthetic construct
  source 1..19: mol_type = other RNA
ggcaaaagccgggaggacc

SEQ ID NO: 321 - RNA, 19 nt, synthetic construct
  source 1..19: mol_type = other RNA
gcaaaagccgggaggaccg

SEQ ID NO: 322 - DNA, 19 bp, synthetic construct
  source 1..19: mol_type = other DNA
  misc_feature 1: note = RNA
  misc_feature 2: note = DNA
  misc_feature 3..8: note = RNA
  misc_feature 9: note = DNA
  misc_feature 10..18: note = RNA
  misc_feature 19: note = DNA
ctgcgcggtggcacagcct

SEQ ID NO: 323 - DNA, 19 bp, synthetic construct
  source 1..19: mol_type = other DNA
  misc_feature 1: note = DNA
  misc_feature 2..7: note = RNA
  misc_feature 8: note = DNA
  misc_feature 9..17: note = RNA
  misc_feature 18: note = DNA
  misc_feature 19: note = RNA
tgcgcggtggcacagcctg

SEQ ID NO: 324 - DNA, 19 bp, synthetic construct
  source 1..19: mol_type = other DNA
  misc_feature 1..7: note = RNA
  misc_feature 8: note = DNA
  misc_feature 9..16: note = RNA
  misc_feature 17: note = DNA
  misc_feature 18..19: note = RNA
cacagcctgggcccgctca

SEQ ID NO: 325 - DNA, 19 bp, synthetic construct
  source 1..19: mol_type = other DNA
  misc_feature 1..6: note = RNA
  misc_feature 7: note = DNA
  misc_feature 8..15: note = RNA
  misc_feature 16: note = DNA
  misc_feature 17..19: note = RNA
acagcctgggcccgctcaa

SEQ ID NO: 326 - DNA, 19 bp, synthetic construct
  source 1..19: mol_type = other DNA
  misc_feature 1..5: note = RNA
  misc_feature 6: note = DNA
  misc_feature 7..14: note = RNA
  misc_feature 15: note = DNA
  misc_feature 16..19: note = RNA
cagcctgggcccgctcaag

SEQ ID NO: 327 - DNA, 19 bp, synthetic construct
  source 1..19: mol_type = other DNA
  misc_feature 1..4: note = RNA
  misc_feature 5: note = DNA
  misc_feature 6..13: note = RNA
  misc_feature 14: note = DNA
  misc_feature 15..19: note = RNA
agcctgggcccgctcaagc

SEQ ID NO: 328 - DNA, 19 bp, synthetic construct
  source 1..19: mol_type = other DNA
  misc_feature 1..15: note = RNA
  misc_feature 16: note = DNA
  misc_feature 17..18: note = RNA
  misc_feature 19: note = DNA
cgcagggccaaggggtgct

SEQ ID NO: 329 - DNA, 19 bp, synthetic construct
  source 1..19: mol_type = other DNA
  misc_feature 1..14: note = RNA
  misc_feature 15: note = DNA
  misc_feature 16..17: note = RNA
  misc_feature 18..19: note = DNA
gcagggccaaggggtgctt

SEQ ID NO: 330 - DNA, 19 bp, synthetic construct
  source 1..19: mol_type = other DNA
  misc_feature 1..9: note = RNA
  misc_feature 10: note = DNA
  misc_feature 11..19: note = RNA
ccacccacgtcccagggga

SEQ ID NO: 331 - DNA, 19 bp, synthetic construct
  source 1..19: mol_type = other DNA
  misc_feature 1..8: note = RNA
  misc_feature 9: note = DNA
  misc_feature 10..19: note = RNA
cacccacgtcccaggggag

SEQ ID NO: 332 - DNA, 19 bp, synthetic construct
  source 1..19: mol_type = other DNA
  misc_feature 1..7: note = RNA
  misc_feature 8: note = DNA
  misc_feature 9..18: note = RNA
  misc_feature 19: note = DNA
acccacgtcccaggggagt

SEQ ID NO: 333 - DNA, 19 bp, synthetic construct
  source 1..19: mol_type = other DNA
  misc_feature 1..10: note = RNA
  misc_feature 11: note = DNA
  misc_feature 12..14: note = RNA
  misc_feature 15: note = DNA
  misc_feature 16..17: note = RNA
  misc_feature 18: note = DNA
  misc_feature 19: note = RNA
cccaggggagtccgtggtg

SEQ ID NO: 334 - DNA, 19 bp, synthetic construct
  source 1..19: mol_type = other DNA
  misc_feature 1..9: note = RNA
  misc_feature 10: note = DNA
  misc_feature 11..13: note = RNA
  misc_feature 14: note = DNA
  misc_feature 15..16: note = RNA
  misc_feature 17: note = DNA
  misc_feature 18..19: note = RNA
ccaggggagtccgtggtgg

SEQ ID NO: 335 - DNA, 19 bp, synthetic construct
  source 1..19: mol_type = other DNA
  misc_feature 1..8: note = RNA
  misc_feature 9: note = DNA
  misc_feature 10..12: note = RNA
  misc_feature 13: note = DNA
  misc_feature 14..15: note = RNA
  misc_feature 16: note = DNA
  misc_feature 17..19: note = RNA
caggggagtccgtggtggg

SEQ ID NO: 336 - DNA, 19 bp, synthetic construct
  source 1..19: mol_type = other DNA
  misc_feature 1..7: note = RNA
  misc_feature 8: note = DNA
  misc_feature 9..11: note = RNA
  misc_feature 12: note = DNA
  misc_feature 13..14: note = RNA
  misc_feature 15: note = DNA
  misc_feature 16..19: note = RNA
aggggagtccgtggtgggg

SEQ ID NO: 337 - DNA, 19 bp, synthetic construct
  source 1..19: mol_type = other DNA
  misc_feature 1..7: note = RNA
  misc_feature 8: note = DNA
  misc_feature 9..19: note = RNA
ggcggcgtgggaaccccaa

SEQ ID NO: 338 - DNA, 19 bp, synthetic construct
  source 1..19: mol_type = other DNA
  misc_feature 1..15: note = RNA
  misc_feature 16: note = DNA
  misc_feature 17..19: note = RNA
ccaagccggggcagctcca

SEQ ID NO: 339 - DNA, 19 bp, synthetic construct
  source 1..19: mol_type = other DNA
  misc_feature 1..14: note = RNA
  misc_feature 15: note = DNA
  misc_feature 16..19: note = RNA
caagccggggcagctccac

SEQ ID NO: 340 - DNA, 19 bp, synthetic construct
  source 1..19: mol_type = other DNA
  misc_feature 1..13: note = RNA
  misc_feature 14: note = DNA
  misc_feature 15..19: note = RNA
aagccggggcagctccacc

SEQ ID NO: 341 - DNA, 19 bp, synthetic construct
  source 1..19: mol_type = other DNA
  misc_feature 1..7: note = RNA
  misc_feature 8: note = DNA
  misc_feature 9..13: note = RNA
  misc_feature 14: note = DNA
  misc_feature 15..19: note = RNA
gggcagctccacctcccca

SEQ ID NO: 342 - DNA, 19 bp, synthetic construct
  source 1..19: mol_type = other DNA
  misc_feature 1..6: note = RNA
  misc_feature 7: note = DNA
  misc_feature 8..12: note = RNA
  misc_feature 13: note = DNA
  misc_feature 14..19: note = RNA
ggcagctccacctccccag

SEQ ID NO: 343 - DNA, 19 bp, synthetic construct
  source 1..19: mol_type = other DNA
  misc_feature 1..5: note = RNA
  misc_feature 6: note = DNA
  misc_feature 7..11: note = RNA
  misc_feature 12: note = DNA
  misc_feature 13..19: note = RNA
gcagctccacctccccagc

SEQ ID NO: 344 - DNA, 19 bp, synthetic construct
  source 1..19: mol_type = other DNA
  misc_feature 1..4: note = RNA
  misc_feature 5: note = DNA
  misc_feature 6..10: note = RNA
  misc_feature 11: note = DNA
  misc_feature 12..19: note = RNA
cagctccacctccccagcc

SEQ ID NO: 345 - DNA, 19 bp, synthetic construct
  source 1..19: mol_type = other DNA
  misc_feature 1..15: note = RNA
  misc_feature 16: note = DNA
  misc_feature 17..19: note = RNA
cgcggcaggggcagatgca

SEQ ID NO: 346 - DNA, 19 bp, synthetic construct
  source 1..19: mol_type = other DNA
  misc_feature 1..13: note = RNA
  misc_feature 14: note = DNA
  misc_feature 15..19: note = RNA
cggcaggggcagatgcaag

SEQ ID NO: 347 - DNA, 19 bp, synthetic construct
  source 1..19: mol_type = other DNA
  misc_feature 1..12: note = RNA
  misc_feature 13: note = DNA
  misc_feature 14..19: note = RNA
ggcaggggcagatgcaagg

SEQ ID NO: 348 - DNA, 19 bp, synthetic construct
  source 1..19: mol_type = other DNA
  misc_feature 1..11: note = RNA
  misc_feature 12: note = DNA
  misc_feature 13..19: note = RNA
gcaggggcagatgcaaggc

SEQ ID NO: 349 - DNA, 19 bp, synthetic construct
  source 1..19: mol_type = other DNA
  misc_feature 1..10: note = RNA
  misc_feature 11: note = DNA
  misc_feature 12..19: note = RNA
caggggcagatgcaaggca

SEQ ID NO: 350 - DNA, 19 bp, synthetic construct
  source 1..19: mol_type = other DNA
  misc_feature 1..9: note = RNA
  misc_feature 10: note = DNA
  misc_feature 11..18: note = RNA
  misc_feature 19: note = DNA
aggggcagatgcaaggcat

SEQ ID NO: 351 - DNA, 19 bp, synthetic construct
  source 1..19: mol_type = other DNA
  misc_feature 1: note = DNA
  misc_feature 2..9: note = RNA
  misc_feature 10: note = DNA
  misc_feature 11..19: note = RNA
tgcaaggcatcccggcgcc

SEQ ID NO: 352 - DNA, 19 bp, synthetic construct
  source 1..19: mol_type = other DNA
  misc_feature 1..7: note = RNA
  misc_feature 8: note = DNA
  misc_feature 9..18: note = RNA
  misc_feature 19: note = DNA
caaggcatcccggcgccct

SEQ ID NO: 353 - DNA, 19 bp, synthetic construct
  source 1..19: mol_type = other DNA
  misc_feature 1..6: note = RNA
  misc_feature 7: note = DNA
  misc_feature 8..17: note = RNA
  misc_feature 18: note = DNA
  misc_feature 19: note = RNA
aaggcatcccggcgccctc

SEQ ID NO: 354 - DNA, 19 bp, synthetic construct
  source 1..19: mol_type = other DNA
  misc_feature 1..2: note = RNA
  misc_feature 3: note = DNA
  misc_feature 4..12: note = RNA
  misc_feature 13: note = DNA
  misc_feature 14..19: note = RNA
cctcccaggcgctccagga

SEQ ID NO: 355 - DNA, 19 bp, synthetic construct
  source 1..19: mol_type = other DNA
  misc_feature 1..7: note = RNA
  misc_feature 8: note = DNA
  misc_feature 9..10: note = RNA
  misc_feature 11: note = DNA
  misc_feature 12: note = RNA
  misc_feature 13: note = DNA
  misc_feature 14..17: note = RNA
  misc_feature 18: note = DNA
  misc_feature 19: note = RNA
ggcgccctggtctgcactc

SEQ ID NO: 356 - DNA, 19 bp, synthetic construct
  source 1..19: mol_type = other DNA
  misc_feature 1..6: note = RNA
  misc_feature 7: note = DNA
  misc_feature 8..9: note = RNA
  misc_feature 10: note = DNA
  misc_feature 11: note = RNA
  misc_feature 12: note = DNA
  misc_feature 13..16: note = RNA
  misc_feature 17: note = DNA
  misc_feature 18..19: note = RNA
gcgccctggtctgcactcc

SEQ ID NO: 357 - DNA, 19 bp, synthetic construct
  source 1..19: mol_type = other DNA
  misc_feature 1..5: note = RNA
  misc_feature 6: note = DNA
  misc_feature 7..8: note = RNA
  misc_feature 9: note = DNA
  misc_feature 10: note = RNA
  misc_feature 11: note = DNA
  misc_feature 12..15: note = RNA
  misc_feature 16: note = DNA
  misc_feature 17..19: note = RNA
cgccctggtctgcactccc

SEQ ID NO: 358 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8: note = DNA
  misc_feature 9: note = RNA
  misc_feature 10: note = DNA
  misc_feature 11..14: note = RNA
  misc_feature 15: note = DNA
  misc_feature 16..19: note = RNA
gccctggtctgcactcccc

SEQ ID NO: 359 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8: note = RNA
  misc_feature 9: note = DNA
  misc_feature 10..13: note = RNA
  misc_feature 14: note = DNA
  misc_feature 15..18: note = RNA
  misc_feature 19: note = DNA
ccctggtctgcactcccct

SEQ ID NO: 360 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7: note = RNA
  misc_feature 8: note = DNA
  misc_feature 9..12: note = RNA
  misc_feature 13: note = DNA
  misc_feature 14..17: note = RNA
  misc_feature 18: note = DNA
  misc_feature 19: note = RNA
cctggtctgcactcccctg

SEQ ID NO: 361 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..16: note = RNA
  misc_feature 17: note = DNA
  misc_feature 18..19: note = RNA
ctggtctgcactcccctgc

SEQ ID NO: 362 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5: note = RNA
  misc_feature 6: note = DNA
  misc_feature 7..10: note = RNA
  misc_feature 11: note = DNA
  misc_feature 12..15: note = RNA
  misc_feature 16: note = DNA
  misc_feature 17..19: note = RNA
tggtctgcactcccctgcg

SEQ ID NO: 363 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..9: note = RNA
  misc_feature 10: note = DNA
  misc_feature 11..14: note = RNA
  misc_feature 15: note = DNA
  misc_feature 16..19: note = RNA
ggtctgcactcccctgcgg

SEQ ID NO: 364 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..8: note = RNA
  misc_feature 9: note = DNA
  misc_feature 10..13: note = RNA
  misc_feature 14: note = DNA
  misc_feature 15..19: note = RNA
gtctgcactcccctgcggc

SEQ ID NO: 365 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..7: note = RNA
  misc_feature 8: note = DNA
  misc_feature 9..12: note = RNA
  misc_feature 13: note = DNA
  misc_feature 14..19: note = RNA
tctgcactcccctgcggcc

SEQ ID NO: 366 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13..18: note = RNA
  misc_feature 19: note = DNA
ctgcactcccctgcggcct

SEQ ID NO: 367 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..10: note = RNA
  misc_feature 11: note = DNA
  misc_feature 12..17: note = RNA
  misc_feature 18: note = DNA
  misc_feature 19: note = RNA
tgcactcccctgcggcctg

SEQ ID NO: 368 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10..15: note = RNA
  misc_feature 16: note = DNA
  misc_feature 17..18: note = RNA
  misc_feature 19: note = DNA
cactcccctgcggcctgct

SEQ ID NO: 369 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9..14: note = RNA
  misc_feature 15: note = DNA
  misc_feature 16..17: note = RNA
  misc_feature 18: note = DNA
  misc_feature 19: note = RNA
actcccctgcggcctgctg

SEQ ID NO: 370 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..12: note = RNA
  misc_feature 13: note = DNA
  misc_feature 14..15: note = RNA
  misc_feature 16: note = DNA
  misc_feature 17..18: note = RNA
  misc_feature 19: note = DNA
tcccctgcggcctgctgct

SEQ ID NO: 371 - DNA, 19 bp, synthetic construct
  source 1..19: mol_type = other DNA
  misc_feature 1..2: note = RNA
  misc_feature 3: note = DNA
  misc_feature 4..9: note = RNA
  misc_feature 10: note = DNA
  misc_feature 11..12: note = RNA
  misc_feature 13: note = DNA
  misc_feature 14..15: note = RNA
  misc_feature 16: note = DNA
  misc_feature 17..19: note = RNA
cctgcggcctgctgctgga

SEQ ID NO: 372 - DNA, 19 bp, synthetic construct
  source 1..19: mol_type = other DNA
  misc_feature 1: note = RNA
  misc_feature 2: note = DNA
  misc_feature 3..8: note = RNA
  misc_feature 9: note = DNA
  misc_feature 10..11: note = RNA
  misc_feature 12: note = DNA
  misc_feature 13..14: note = RNA
  misc_feature 15: note = DNA
  misc_feature 16..18: note = RNA
  misc_feature 19: note = DNA
ctgcggcctgctgctggat

SEQ ID NO: 373 - DNA, 19 bp, synthetic construct
  source 1..19: mol_type = other DNA
  misc_feature 1: note = DNA
  misc_feature 2..7: note = RNA
  misc_feature 8: note = DNA
  misc_feature 9..10: note = RNA
  misc_feature 11: note = DNA
  misc_feature 12..13: note = RNA
  misc_feature 14: note = DNA
  misc_feature 15..17: note = RNA
  misc_feature 18: note = DNA
  misc_feature 19: note = RNA
tgcggcctgctgctggatg

SEQ ID NO: 374 - DNA, 19 bp, synthetic construct
  source 1..19: mol_type = other DNA
  misc_feature 1..6: note = RNA
  misc_feature 7: note = DNA
  misc_feature 8..9: note = RNA
  misc_feature 10: note = DNA
  misc_feature 11..12: note = RNA
  misc_feature 13: note = DNA
  misc_feature 14..16: note = RNA
  misc_feature 17: note = DNA
  misc_feature 18..19: note = RNA
gcggcctgctgctggatga

SEQ ID NO: 375 - DNA, 19 bp, synthetic construct
  source 1..19: mol_type = other DNA
  misc_feature 1..5: note = RNA
  misc_feature 6: note = DNA
  misc_feature 7..8: note = RNA
  misc_feature 9: note = DNA
  misc_feature 10..11: note = RNA
  misc_feature 12: note = DNA
  misc_feature 13..15: note = RNA
  misc_feature 16: note = DNA
  misc_feature 17..19: note = RNA
cggcctgctgctggatgag

SEQ ID NO: 376 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8: note = DNA
  misc_feature 9..10: note = RNA
  misc_feature 11: note = DNA
  misc_feature 12..14: note = RNA
  misc_feature 15: note = DNA
  misc_feature 16..19: note = RNA
ggcctgctgctggatgagc

SEQ ID NO: 377 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..9: note = RNA
  misc_feature 10: note = DNA
  misc_feature 11..13: note = RNA
  misc_feature 14: note = DNA
  misc_feature 15..18: note = RNA
  misc_feature 19: note = DNA
gcctgctgctggatgagct

SEQ ID NO: 378 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..8: note = RNA
  misc_feature 9: note = DNA
  misc_feature 10..12: note = RNA
  misc_feature 13: note = DNA
  misc_feature 14..17: note = RNA
  misc_feature 18: note = DNA
  misc_feature 19: note = RNA
cctgctgctggatgagctc

SEQ ID NO: 379 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..7: note = RNA
  misc_feature 8: note = DNA
  misc_feature 9..11: note = RNA
  misc_feature 12: note = DNA
  misc_feature 13..16: note = RNA
  misc_feature 17: note = DNA
  misc_feature 18..19: note = RNA
ctgctgctggatgagctcc

SEQ ID NO: 380 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..6: note = RNA
  misc_feature 7: note = DNA
  misc_feature 8..10: note = RNA
  misc_feature 11: note = DNA
  misc_feature 12..15: note = RNA
  misc_feature 16: note = DNA
  misc_feature 17..18: note = RNA
  misc_feature 19: note = DNA
tgctgctggatgagctcct

SEQ ID NO: 381 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..9: note = RNA
  misc_feature 10: note = DNA
  misc_feature 11..14: note = RNA
  misc_feature 15: note = DNA
  misc_feature 16..17: note = RNA
  misc_feature 18: note = DNA
  misc_feature 19: note = RNA
gctgctggatgagctcctg

SEQ ID NO: 382 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..8: note = RNA
  misc_feature 9: note = DNA
  misc_feature 10..13: note = RNA
  misc_feature 14: note = DNA
  misc_feature 15..16: note = RNA
  misc_feature 17: note = DNA
  misc_feature 18..19: note = RNA
ctgctggatgagctcctgg

SEQ ID NO: 383 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..7: note = RNA
  misc_feature 8: note = DNA
  misc_feature 9..12: note = RNA
  misc_feature 13: note = DNA
  misc_feature 14..15: note = RNA
  misc_feature 16: note = DNA
  misc_feature 17..19: note = RNA
tgctggatgagctcctggc

SEQ ID NO: 384 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..11: note = RNA
  misc_feature 12: note = DNA
  misc_feature 13..14: note = RNA
  misc_feature 15: note = DNA
  misc_feature 16..19: note = RNA
gctggatgagctcctggcg

SEQ ID NO: 385 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..17: note = RNA
  misc_feature 18..19: note = DNA
tcctggcgagcccggagtt

SEQ ID NO: 386 - DNA, 19 bp, synthetic construct
  source 1..19: mol_type = other DNA
  misc_feature 1..2: note = RNA
  misc_feature 3: note = DNA
  misc_feature 4..16: note = RNA
  misc_feature 17..19: note = DNA
cctggcgagcccggagttt

SEQ ID NO: 387 - DNA, 19 bp, synthetic construct
  source 1..19: mol_type = other DNA
  misc_feature 1: note = RNA
  misc_feature 2: note = DNA
  misc_feature 3..15: note = RNA
  misc_feature 16..18: note = DNA
  misc_feature 19: note = RNA
ctggcgagcccggagtttc

SEQ ID NO: 388 - DNA, 19 bp, synthetic construct
  source 1..19: mol_type = other DNA
  misc_feature 1..10: note = RNA
  misc_feature 11..13: note = DNA
  misc_feature 14: note = RNA
  misc_feature 15: note = DNA
  misc_feature 16..19: note = RNA
gagcccggagtttctgcag

SEQ ID NO: 389 - DNA, 19 bp, synthetic construct
  source 1..19: mol_type = other DNA
  misc_feature 1..9: note = RNA
  misc_feature 10..12: note = DNA
  misc_feature 13: note = RNA
  misc_feature 14: note = DNA
  misc_feature 15..19: note = RNA
agcccggagtttctgcagc

SEQ ID NO: 390 - DNA, 19 bp, synthetic construct
  source 1..19: mol_type = other DNA
  misc_feature 1..8: note = RNA
  misc_feature 9..11: note = DNA
  misc_feature 12: note = RNA
  misc_feature 13: note = DNA
  misc_feature 14..19: note = RNA
gcccggagtttctgcagca

SEQ ID NO: 391 - DNA, 19 bp, synthetic construct
  source 1..19: mol_type = other DNA
  misc_feature 1..7: note = RNA
  misc_feature 8..10: note = DNA
  misc_feature 11: note = RNA
  misc_feature 12: note = DNA
  misc_feature 13..19: note = RNA
cccggagtttctgcagcag

SEQ ID NO: 392 - DNA, 19 bp, synthetic construct
  source 1..19: mol_type = other DNA
  misc_feature 1..6: note = RNA
  misc_feature 7..9: note = DNA
  misc_feature 10: note = RNA
  misc_feature 11: note = DNA
  misc_feature 12..19: note = RNA
ccggagtttctgcagcagg

SEQ ID NO: 393 - DNA, 19 bp, synthetic construct
  source 1..19: mol_type = other DNA
  misc_feature 1..5: note = RNA
  misc_feature 6..8: note = DNA
  misc_feature 9: note = RNA
  misc_feature 10: note = DNA
  misc_feature 11..19: note = RNA
cggagtttctgcagcaggc

SEQ ID NO: 394 - DNA, 19 bp, synthetic construct
  source 1..19: mol_type = other DNA
  misc_feature 1..4: note = RNA
  misc_feature 5..7: note = DNA
  misc_feature 8: note = RNA
  misc_feature 9: note = DNA
  misc_feature 10..19: note = RNA
ggagtttctgcagcaggcg

SEQ ID NO: 395 - DNA, 19 bp, synthetic construct
  source 1..19: mol_type = other DNA
  misc_feature 1..3: note = RNA
  misc_feature 4..6: note = DNA
  misc_feature 7: note = RNA
  misc_feature 8: note = DNA
  misc_feature 9..19: note = RNA
gagtttctgcagcaggcgc

SEQ ID NO: 396 - DNA, 19 bp, synthetic construct
  source 1..19: mol_type = other DNA
  misc_feature 1..2: note = RNA
  misc_feature 3..5: note = DNA
  misc_feature 6: note = RNA
  misc_feature 7: note = DNA
  misc_feature 8..19: note = RNA
agtttctgcagcaggcgca

SEQ ID NO: 397 - DNA, 19 bp, synthetic construct
  source 1..19: mol_type = other DNA
  misc_feature 1: note = RNA
  misc_feature 2..4: note = DNA
  misc_feature 5: note = RNA
  misc_feature 6: note = DNA
  misc_feature 7..19: note = RNA
gtttctgcagcaggcgcaa

SEQ ID NO: 398 - DNA, 19 bp, synthetic construct
  source 1..19: mol_type = other DNA
  misc_feature 1..3: note = DNA
  misc_feature 4: note = RNA
  misc_feature 5: note = DNA
  misc_feature 6..19: note = RNA
tttctgcagcaggcgcaac

SEQ ID NO: 399 - DNA, 19 bp, synthetic construct
  source 1..19: mol_type = other DNA
  misc_feature 1..2: note = DNA
  misc_feature 3: note = RNA
  misc_feature 4: note = DNA
  misc_feature 5..19: note = RNA
ttctgcagcaggcgcaacc

SEQ ID NO: 400 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..18: note = RNA
  misc_feature 19: note = DNA
tctgcagcaggcgcaacct

SEQ ID NO: 401 - DNA, 19 bp, synthetic construct
  source 1..19: mol_type = other DNA
  misc_feature 1: note = RNA
  misc_feature 2: note = DNA
  misc_feature 3..17: note = RNA
  misc_feature 18: note = DNA
  misc_feature 19: note = RNA
ctgcagcaggcgcaacctc

SEQ ID NO: 402 - DNA, 19 bp, synthetic construct
  source 1..19: mol_type = other DNA
  misc_feature 1: note = DNA
  misc_feature 2..16: note = RNA
  misc_feature 17: note = DNA
  misc_feature 18: note = RNA
  misc_feature 19: note = DNA
tgcagcaggcgcaacctct

SEQ ID NO: 403 - DNA, 19 bp, synthetic construct
  source 1..19: mol_type = other DNA
  misc_feature 1..15: note = RNA
  misc_feature 16: note = DNA
  misc_feature 17: note = RNA
  misc_feature 18: note = DNA
  misc_feature 19: note = RNA
gcagcaggcgcaacctctc

SEQ ID NO: 404 - DNA, 19 bp, synthetic construct
  source 1..19: mol_type = other DNA
  misc_feature 1..14: note = RNA
  misc_feature 15: note = DNA
  misc_feature 16: note = RNA
  misc_feature 17: note = DNA
  misc_feature 18..19: note = RNA
cagcaggcgcaacctctcc

SEQ ID NO: 405 - DNA, 19 bp, synthetic construct
  source 1..19: mol_type = other DNA
  misc_feature 1..13: note = RNA
  misc_feature 14: note = DNA
  misc_feature 15: note = RNA
  misc_feature 16: note = DNA
  misc_feature 17..18: note = RNA
  misc_feature 19: note = DNA
agcaggcgcaacctctcct

SEQ ID NO: 406 - DNA, 19 bp, synthetic construct
  source 1..19: mol_type = other DNA
  misc_feature 1..12: note = RNA
  misc_feature 13: note = DNA
  misc_feature 14: note = RNA
  misc_feature 15: note = DNA
  misc_feature 16..17: note = RNA
  misc_feature 18: note = DNA
  misc_feature 19: note = RNA
gcaggcgcaacctctccta

SEQ ID NO: 407 - DNA, 19 bp, synthetic construct
  source 1..19: mol_type = other DNA
  misc_feature 1..11: note = RNA
  misc_feature 12: note = DNA
  misc_feature 13: note = RNA
  misc_feature 14: note = DNA
  misc_feature 15..16: note = RNA
  misc_feature 17: note = DNA
  misc_feature 18..19: note = RNA
caggcgcaacctctcctag

SEQ ID NO: 408 - DNA, 19 bp, synthetic construct
  source 1..19: mol_type = other DNA
  misc_feature 1..10: note = RNA
  misc_feature 11: note = DNA
  misc_feature 12: note = RNA
  misc_feature 13: note = DNA
  misc_feature 14..15: note = RNA
  misc_feature 16: note = DNA
  misc_feature 17..19: note = RNA
aggcgcaacctctcctaga

SEQ ID NO: 409 - DNA, 19 bp, synthetic construct
  source 1..19: mol_type = other DNA
  misc_feature 1..9: note = RNA
  misc_feature 10: note = DNA
  misc_feature 11: note = RNA
  misc_feature 12: note = DNA
  misc_feature 13..14: note = RNA
  misc_feature 15: note = DNA
  misc_feature 16..19: note = RNA
ggcgcaacctctcctagaa

SEQ ID NO: 410 - DNA, 19 bp, synthetic construct
  source 1..19: mol_type = other DNA
  misc_feature 1..8: note = RNA
  misc_feature 9: note = DNA
  misc_feature 10: note = RNA
  misc_feature 11: note = DNA
  misc_feature 12..13: note = RNA
  misc_feature 14: note = DNA
  misc_feature 15..19: note = RNA
gcgcaacctctcctagaaa

SEQ ID NO: 411 - DNA, 19 bp, synthetic construct
  source 1..19: mol_type = other DNA
  misc_feature 1..7: note = RNA
  misc_feature 8: note = DNA
  misc_feature 9: note = RNA
  misc_feature 10: note = DNA
  misc_feature 11..12: note = RNA
  misc_feature 13: note = DNA
  misc_feature 14..19: note = RNA
cgcaacctctcctagaaac

SEQ ID NO: 412 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..11: note = RNA
  misc_feature 12: note = DNA
  misc_feature 13..19: note = RNA
gcaacctctcctagaaacg

SEQ ID NO: 413 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..10: note = RNA
  misc_feature 11: note = DNA
  misc_feature 12..19: note = RNA
caacctctcctagaaacgg

SEQ ID NO: 414 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..9: note = RNA
  misc_feature 10: note = DNA
  misc_feature 11..19: note = RNA
aacctctcctagaaacgga

SEQ ID NO: 415 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..19: note = RNA
tcctagaaacggaggcccc

SEQ ID NO: 416 - DNA, 19 bp, synthetic construct
  source 1..19: mol_type = other DNA
  misc_feature 1..2: note = RNA
  misc_feature 3: note = DNA
  misc_feature 4..19: note = RNA
cctagaaacggaggccccg

SEQ ID NO: 417 - DNA, 19 bp, synthetic construct
  source 1..19: mol_type = other DNA
  misc_feature 1: note = RNA
  misc_feature 2: note = DNA
  misc_feature 3..19: note = RNA
ctagaaacggaggccccgg

SEQ ID NO: 418 - DNA, 19 bp, synthetic construct
  source 1..19: mol_type = other DNA
  misc_feature 1..4: note = RNA
  misc_feature 5: note = DNA
  misc_feature 6..12: note = RNA
  misc_feature 13: note = DNA
  misc_feature 14..17: note = RNA
  misc_feature 18: note = DNA
  misc_feature 19: note = RNA
ccggtgagagactccactc

SEQ ID NO: 419 - DNA, 19 bp, synthetic construct
  source 1..19: mol_type = other DNA
  misc_feature 1..3: note = RNA
  misc_feature 4: note = DNA
  misc_feature 5..11: note = RNA
  misc_feature 12: note = DNA
  misc_feature 13..16: note = RNA
  misc_feature 17: note = DNA
  misc_feature 18..19: note = RNA
cggtgagagactccactcc

SEQ ID NO: 420 - DNA, 19 bp, synthetic construct
  source 1..19: mol_type = other DNA
  misc_feature 1..2: note = RNA
  misc_feature 3: note = DNA
  misc_feature 4..10: note = RNA
  misc_feature 11: note = DNA
  misc_feature 12..15: note = RNA
  misc_feature 16: note = DNA
  misc_feature 17..19: note = RNA
ggtgagagactccactccg

SEQ ID NO: 421 - DNA, 19 bp, synthetic construct
  source 1..19: mol_type = other DNA
  misc_feature 1..3: note = RNA
  misc_feature 4..5: note = DNA
  misc_feature 6: note = RNA
  misc_feature 7..8: note = DNA
  misc_feature 9: note = RNA
  misc_feature 10..11: note = DNA
  misc_feature 12..14: note = RNA
  misc_feature 15: note = DNA
  misc_feature 16..19: note = RNA
cccttgttcttccgtgaaa

SEQ ID NO: 422 - DNA, 19 bp, synthetic construct
  source 1..19: mol_type = other DNA
  misc_feature 1..2: note = RNA
  misc_feature 3..4: note = DNA
  misc_feature 5: note = RNA
  misc_feature 6..7: note = DNA
  misc_feature 8: note = RNA
  misc_feature 9..10: note = DNA
  misc_feature 11..13: note = RNA
  misc_feature 14: note = DNA
  misc_feature 15..18: note = RNA
  misc_feature 19: note = DNA
ccttgttcttccgtgaaat

SEQ ID NO: 423 - DNA, 19 bp, synthetic construct
  source 1..19: mol_type = other DNA
  misc_feature 1: note = RNA
  misc_feature 2..3: note = DNA
  misc_feature 4: note = RNA
  misc_feature 5..6: note = DNA
  misc_feature 7: note = RNA
  misc_feature 8..9: note = DNA
  misc_feature 10..12: note = RNA
  misc_feature 13: note = DNA
  misc_feature 14..17: note = RNA
  misc_feature 18..19: note = DNA
cttgttcttccgtgaaatt

SEQ ID NO: 424 - DNA, 19 bp, synthetic construct
  source 1..19: mol_type = other DNA
  misc_feature 1..2: note = DNA
  misc_feature 3: note = RNA
  misc_feature 4..5: note = DNA
  misc_feature 6: note = RNA
  misc_feature 7..8: note = DNA
  misc_feature 9..11: note = RNA
  misc_feature 12: note = DNA
  misc_feature 13..16: note = RNA
  misc_feature 17..18: note = DNA
  misc_feature 19: note = RNA
ttgttcttccgtgaaattc

SEQ ID NO: 425 - DNA, 19 bp, synthetic construct
  source 1..19: mol_type = other DNA
  misc_feature 1: note = DNA
  misc_feature 2: note = RNA
  misc_feature 3..4: note = DNA
  misc_feature 5: note = RNA
  misc_feature 6..7: note = DNA
  misc_feature 8..10: note = RNA
  misc_feature 11: note = DNA
  misc_feature 12..15: note = RNA
  misc_feature 16..17: note = DNA
  misc_feature 18: note = RNA
  misc_feature 19: note = DNA
tgttcttccgtgaaattct

SEQ ID NO: 426 - DNA, 19 bp, synthetic construct
  source 1..19: mol_type = other DNA
  misc_feature 1: note = RNA
  misc_feature 2..3: note = DNA
  misc_feature 4: note = RNA
  misc_feature 5..6: note = DNA
  misc_feature 7..9: note = RNA
  misc_feature 10: note = DNA
  misc_feature 11..14: note = RNA
  misc_feature 15..16: note = DNA
  misc_feature 17: note = RNA
  misc_feature 18: note = DNA
  misc_feature 19: note = RNA
gttcttccgtgaaattctg

SEQ ID NO: 427 - DNA, 19 bp, synthetic construct
  source 1..19: mol_type = other DNA
  misc_feature 1..2: note = DNA
  misc_feature 3: note = RNA
  misc_feature 4..5: note = DNA
  misc_feature 6..8: note = RNA
  misc_feature 9: note = DNA
  misc_feature 10..13: note = RNA
  misc_feature 14..15: note = DNA
  misc_feature 16: note = RNA
  misc_feature 17: note = DNA
  misc_feature 18..19: note = RNA
ttcttccgtgaaattctgg

SEQ ID NO: 428 - DNA, 19 bp, synthetic construct
  source 1..19: mol_type = other DNA
  misc_feature 1: note = DNA
  misc_feature 2: note = RNA
  misc_feature 3..4: note = DNA
  misc_feature 5..7: note = RNA
  misc_feature 8: note = DNA
  misc_feature 9..12: note = RNA
  misc_feature 13..14: note = DNA
  misc_feature 15: note = RNA
  misc_feature 16: note = DNA
  misc_feature 17..19: note = RNA
tcttccgtgaaattctggc

SEQ ID NO: 429 - DNA, 19 bp, synthetic construct
  source 1..19: mol_type = other DNA
  misc_feature 1: note = RNA
  misc_feature 2..3: note = DNA
  misc_feature 4..6: note = RNA
  misc_feature 7: note = DNA
  misc_feature 8..11: note = RNA
  misc_feature 12..13: note = DNA
  misc_feature 14: note = RNA
  misc_feature 15: note = DNA
  misc_feature 16..18: note = RNA
  misc_feature 19: note = DNA
cttccgtgaaattctggct

SEQ ID NO: 430 - DNA, 19 bp, synthetic construct
  source 1..19: mol_type = other DNA
  misc_feature 1..2: note = DNA
  misc_feature 3: note = RNA
  misc_feature 4: note = DNA
  misc_feature 5..7: note = RNA
  misc_feature 8: note = DNA
  misc_feature 9..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..19: note = RNA
ttctggctgaatgtctccc

SEQ ID NO: 431 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..6: note = RNA
  misc_feature 7: note = DNA
  misc_feature 8..10: note = RNA
  misc_feature 11: note = DNA
  misc_feature 12: note = RNA
  misc_feature 13: note = DNA
  misc_feature 14: note = RNA
  misc_feature 15: note = DNA
  misc_feature 16..19: note = RNA
tctggctgaatgtctcccc

SEQ ID NO: 432 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9: note = RNA
  misc_feature 10: note = DNA
  misc_feature 11..19: note = RNA
gacgctgtctaggcaaacc

SEQ ID NO: 433 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8: note = RNA
  misc_feature 9: note = DNA
  misc_feature 10..18: note = RNA
  misc_feature 19: note = DNA
acgctgtctaggcaaacct

SEQ ID NO: 434 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7: note = RNA
  misc_feature 8: note = DNA
  misc_feature 9..17: note = RNA
  misc_feature 18: note = DNA
  misc_feature 19: note = RNA
cgctgtctaggcaaacctg

SEQ ID NO: 435 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6: note = RNA
  misc_feature 7: note = DNA
  misc_feature 8..16: note = RNA
  misc_feature 17: note = DNA
  misc_feature 18..19: note = RNA
gctgtctaggcaaacctgg

SEQ ID NO: 436 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5: note = RNA
  misc_feature 6: note = DNA
  misc_feature 7..15: note = RNA
  misc_feature 16: note = DNA
  misc_feature 17..19: note = RNA
ctgtctaggcaaacctgga

SEQ ID NO: 437 - DNA, 19 bp, synthetic construct
  source 1..19: mol_type = other DNA
  misc_feature 1: note = DNA
  misc_feature 2: note = RNA
  misc_feature 3: note = DNA
  misc_feature 4: note = RNA
  misc_feature 5: note = DNA
  misc_feature 6..14: note = RNA
  misc_feature 15: note = DNA
  misc_feature 16..18: note = RNA
  misc_feature 19: note = DNA
tgtctaggcaaacctggat

SEQ ID NO: 438 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..13: note = RNA
  misc_feature 14: note = DNA
  misc_feature 15..17: note = RNA
  misc_feature 18..19: note = DNA
gtctaggcaaacctggatt

SEQ ID NO: 439 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..12: note = RNA
  misc_feature 13: note = DNA
  misc_feature 14..16: note = RNA
  misc_feature 17..18: note = DNA
  misc_feature 19: note = RNA
tctaggcaaacctggatta

SEQ ID NO: 440 - DNA, 19 bp, synthetic construct
  source 1..19: mol_type = other DNA
  misc_feature 1: note = RNA
  misc_feature 2: note = DNA
  misc_feature 3..11: note = RNA
  misc_feature 12: note = DNA
  misc_feature 13..15: note = RNA
  misc_feature 16..17: note = DNA
  misc_feature 18..19: note = RNA
ctaggcaaacctggattag

SEQ ID NO: 441 - DNA, 19 bp, synthetic construct
  source 1..19: mol_type = other DNA
  misc_feature 1: note = DNA
  misc_feature 2..10: note = RNA
  misc_feature 11: note = DNA
  misc_feature 12..14: note = RNA
  misc_feature 15..16: note = DNA
  misc_feature 17..19: note = RNA
taggcaaacctggattaga

SEQ ID NO: 442 - DNA, 19 bp, synthetic construct
  source 1..19: mol_type = other DNA
  misc_feature 1..9: note = RNA
  misc_feature 10: note = DNA
  misc_feature 11..13: note = RNA
  misc_feature 14..15: note = DNA
  misc_feature 16..19: note = RNA
aggcaaacctggattagag

SEQ ID NO: 443 - DNA, 19 bp, synthetic construct
  source 1..19: mol_type = other DNA
  misc_feature 1..8: note = RNA
  misc_feature 9: note = DNA
  misc_feature 10..12: note = RNA
  misc_feature 13..14: note = DNA
  misc_feature 15..18: note = RNA
  misc_feature 19: note = DNA
ggcaaacctggattagagt

SEQ ID NO: 444 - DNA, 19 bp, synthetic construct
  source 1..19: mol_type = other DNA
  misc_feature 1..7: note = RNA
  misc_feature 8: note = DNA
  misc_feature 9..11: note = RNA
  misc_feature 12..13: note = DNA
  misc_feature 14..17: note = RNA
  misc_feature 18..19: note = DNA
gcaaacctggattagagtt

SEQ ID NO: 445 - DNA, 19 bp, synthetic construct
  source 1..19: mol_type = other DNA
  misc_feature 1..6: note = RNA
  misc_feature 7: note = DNA
  misc_feature 8..10: note = RNA
  misc_feature 11..12: note = DNA
  misc_feature 13..16: note = RNA
  misc_feature 17..18: note = DNA
  misc_feature 19: note = RNA
caaacctggattagagtta

SEQ ID NO: 446 - DNA, 19 bp, synthetic construct
  source 1..19: mol_type = other DNA
  misc_feature 1..5: note = RNA
  misc_feature 6: note = DNA
  misc_feature 7..9: note = RNA
  misc_feature 10..11: note = DNA
  misc_feature 12..15: note = RNA
  misc_feature 16..17: note = DNA
  misc_feature 18..19: note = RNA
aaacctggattagagttac

SEQ ID NO: 447 - DNA, 19 bp, synthetic construct
  source 1..19: mol_type = other DNA
  misc_feature 1..4: note = RNA
  misc_feature 5: note = DNA
  misc_feature 6..8: note = RNA
  misc_feature 9..10: note = DNA
  misc_feature 11..14: note = RNA
  misc_feature 15..16: note = DNA
  misc_feature 17..19: note = RNA
aacctggattagagttaca

SEQ ID NO: 448 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8..9: note = DNA
  misc_feature 10..13: note = RNA
  misc_feature 14..15: note = DNA
  misc_feature 16..18: note = RNA
  misc_feature 19: note = DNA
acctggattagagttacat

SEQ ID NO: 449 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7..8: note = DNA
  misc_feature 9..12: note = RNA
  misc_feature 13..14: note = DNA
  misc_feature 15..17: note = RNA
  misc_feature 18: note = DNA
  misc_feature 19: note = RNA
cctggattagagttacatc

SEQ ID NO: 450 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6..7: note = DNA
  misc_feature 8..11: note = RNA
  misc_feature 12..13: note = DNA
  misc_feature 14..16: note = RNA
  misc_feature 17: note = DNA
  misc_feature 18: note = RNA
  misc_feature 19: note = DNA
ctggattagagttacatct

SEQ ID NO: 451 - DNA, 19 bp, synthetic construct
  source 1..19: mol_type = other DNA
  misc_feature 1: note = DNA
  misc_feature 2..4: note = RNA
  misc_feature 5..6: note = DNA
  misc_feature 7..10: note = RNA
  misc_feature 11..12: note = DNA
  misc_feature 13..15: note = RNA
  misc_feature 16: note = DNA
  misc_feature 17: note = RNA
  misc_feature 18: note = DNA
  misc_feature 19: note = RNA
tggattagagttacatctc

SEQ ID NO: 452 - DNA, 19 bp, synthetic construct
  source 1..19: mol_type = other DNA
  misc_feature 1..3: note = RNA
  misc_feature 4..5: note = DNA
  misc_feature 6..9: note = RNA
  misc_feature 10..11: note = DNA
  misc_feature 12..14: note = RNA
  misc_feature 15: note = DNA
  misc_feature 16: note = RNA
  misc_feature 17: note = DNA
  misc_feature 18..19: note = RNA
ggattagagttacatctcc

SEQ ID NO: 453 - DNA, 19 bp, synthetic construct
  source 1..19: mol_type = other DNA
  misc_feature 1..2: note = RNA
  misc_feature 3..4: note = DNA
  misc_feature 5..8: note = RNA
  misc_feature 9..10: note = DNA
  misc_feature 11..13: note = RNA
  misc_feature 14: note = DNA
  misc_feature 15: note = RNA
  misc_feature 16: note = DNA
  misc_feature 17..18: note = RNA
  misc_feature 19: note = DNA
gattagagttacatctcct

SEQ ID NO: 454 - DNA, 19 bp, synthetic construct
  source 1..19: mol_type = other DNA
  misc_feature 1: note = RNA
  misc_feature 2..3: note = DNA
  misc_feature 4..7: note = RNA
  misc_feature 8..9: note = DNA
  misc_feature 10..12: note = RNA
  misc_feature 13: note = DNA
  misc_feature 14: note = RNA
  misc_feature 15: note = DNA
  misc_feature 16..17: note = RNA
  misc_feature 18: note = DNA
  misc_feature 19: note = RNA
attagagttacatctcctg

SEQ ID NO: 455 - DNA, 19 bp, synthetic construct
  source 1..19: mol_type = other DNA
  misc_feature 1..2: note = DNA
  misc_feature 3..6: note = RNA
  misc_feature 7..8: note = DNA
  misc_feature 9..11: note = RNA
  misc_feature 12: note = DNA
  misc_feature 13: note = RNA
  misc_feature 14: note = DNA
  misc_feature 15..16: note = RNA
  misc_feature 17: note = DNA
  misc_feature 18..19: note = RNA
ttagagttacatctcctgg

SEQ ID NO: 456 - DNA, 19 bp, synthetic construct
  source 1..19: mol_type = other DNA
  misc_feature 1: note = DNA
  misc_feature 2..5: note = RNA
  misc_feature 6..7: note = DNA
  misc_feature 8..10: note = RNA
  misc_feature 11: note = DNA
  misc_feature 12: note = RNA
  misc_feature 13: note = DNA
  misc_feature 14..15: note = RNA
  misc_feature 16: note = DNA
  misc_feature 17..19: note = RNA
tagagttacatctcctgga

SEQ ID NO: 457 - DNA, 19 bp, synthetic construct
  source 1..19: mol_type = other DNA
  misc_feature 1..4: note = RNA
  misc_feature 5..6: note = DNA
  misc_feature 7..9: note = RNA
  misc_feature 10: note = DNA
  misc_feature 11: note = RNA
  misc_feature 12: note = DNA
  misc_feature 13..14: note = RNA
  misc_feature 15: note = DNA
  misc_feature 16..18: note = RNA
  misc_feature 19: note = DNA
agagttacatctcctggat

SEQ ID NO: 458 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..6: note = RNA
  misc_feature 7: note = DNA
  misc_feature 8..10: note = RNA
  misc_feature 11: note = DNA
  misc_feature 12..13: note = RNA
  misc_feature 14..15: note = DNA
  misc_feature 16..17: note = RNA
  misc_feature 18..19: note = DNA
atctcctggatgattagtt

SEQ ID NO: 459 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..5: note = RNA
  misc_feature 6: note = DNA
  misc_feature 7..9: note = RNA
  misc_feature 10: note = DNA
  misc_feature 11..12: note = RNA
  misc_feature 13..14: note = DNA
  misc_feature 15..16: note = RNA
  misc_feature 17..18: note = DNA
  misc_feature 19: note = RNA
tctcctggatgattagttc

SEQ ID NO: 460 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..8: note = RNA
  misc_feature 9: note = DNA
  misc_feature 10..11: note = RNA
  misc_feature 12..13: note = DNA
  misc_feature 14..15: note = RNA
  misc_feature 16..17: note = DNA
  misc_feature 18..19: note = RNA
ctcctggatgattagttca

SEQ ID NO: 461 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..7: note = RNA
  misc_feature 8: note = DNA
  misc_feature 9..10: note = RNA
  misc_feature 11..12: note = DNA
  misc_feature 13..14: note = RNA
  misc_feature 15..16: note = DNA
  misc_feature 17..19: note = RNA
tcctggatgattagttcag

SEQ ID NO: 462 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..9: note = RNA
  misc_feature 10..11: note = DNA
  misc_feature 12..13: note = RNA
  misc_feature 14..15: note = DNA
  misc_feature 16..19: note = RNA
cctggatgattagttcaga

SEQ ID NO: 463 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..8: note = RNA
  misc_feature 9..10: note = DNA
  misc_feature 11..12: note = RNA
  misc_feature 13..14: note = DNA
  misc_feature 15..19: note = RNA
ctggatgattagttcagag

SEQ ID NO: 464 - DNA, 19 bp, synthetic construct
  source 1..19: mol_type = other DNA
  misc_feature 1..6: note = RNA
  misc_feature 7: note = DNA
  misc_feature 8..19: note = RNA
gcaccctccccgcggaagc

SEQ ID NO: 465 - DNA, 19 bp, synthetic construct
  source 1..19: mol_type = other DNA
  misc_feature 1..5: note = RNA
  misc_feature 6: note = DNA
  misc_feature 7..19: note = RNA
caccctccccgcggaagcc

SEQ ID NO: 466 - DNA, 19 bp, synthetic construct
  source 1..19: mol_type = other DNA
  misc_feature 1..4: note = RNA
  misc_feature 5: note = DNA
  misc_feature 6..19: note = RNA
accctccccgcggaagccc

SEQ ID NO: 467 - DNA, 19 bp, synthetic construct
  source 1..19: mol_type = other DNA
  misc_feature 1..2: note = RNA
  misc_feature 3: note = DNA
  misc_feature 4..19: note = RNA
cctccccgcggaagcccgg

SEQ ID NO: 468 - RNA, 19 nt, synthetic construct
  source 1..19: mol_type = other RNA
ccgcggaagcccggggacg

SEQ ID NO: 469 - RNA, 19 nt, synthetic construct
  source 1..19: mol_type = other RNA
gcggaagcccggggacgag

SEQ ID NO: 470 - RNA, 19 nt, synthetic construct
  source 1..19: mol_type = other RNA
cggaagcccggggacgagg

SEQ ID NO: 471 - DNA, 19 bp, synthetic construct
  source 1..19: mol_type = other DNA
  misc_feature 1: note = RNA
  misc_feature 2..4: note = DNA
  misc_feature 5..6: note = RNA
  misc_feature 7..9: note = DNA
  misc_feature 10..14: note = RNA
  misc_feature 15: note = DNA
  misc_feature 16..19: note = RNA
atttggtttcagaatgaga

SEQ ID NO: 472 - DNA, 19 bp, synthetic construct
  source 1..19: mol_type = other DNA
  misc_feature 1..11: note = RNA
  misc_feature 12: note = DNA
  misc_feature 13: note = RNA
  misc_feature 14: note = DNA
  misc_feature 15..19: note = RNA
accggcgggaatctcggcc

SEQ ID NO: 473 - DNA, 19 bp, synthetic construct
  source 1..19: mol_type = other DNA
  misc_feature 1..3: note = RNA
  misc_feature 4: note = DNA
  misc_feature 5..19: note = RNA
ccctggcccgggagacgcg

SEQ ID NO: 474 - DNA, 19 bp, synthetic construct
  source 1..19: mol_type = other DNA
  misc_feature 1..2: note = RNA
  misc_feature 3: note = DNA
  misc_feature 4..19: note = RNA
cctggcccgggagacgcgg

SEQ ID NO: 475 - DNA, 19 bp, synthetic construct
  source 1..19: mol_type = other DNA
  misc_feature 1: note = RNA
  misc_feature 2: note = DNA
  misc_feature 3..19: note = RNA
ctggcccgggagacgcggc

SEQ ID NO: 476 - RNA, 19 nt, synthetic construct
  source 1..19: mol_type = other RNA
gacgcggcccgccagaagg

SEQ ID NO: 477 - RNA, 19 nt, synthetic construct
  source 1..19: mol_type = other RNA
acgcggcccgccagaaggc

SEQ ID NO: 478 - RNA, 19 nt, synthetic construct
  source 1..19: mol_type = other RNA
aggccggcgaaagcggacc

SEQ ID NO: 479 - RNA, 19 nt, synthetic construct
  source 1..19: mol_type = other RNA
ggccggcgaaagcggaccg

SEQ ID NO: 480 - RNA, 19 nt, synthetic construct
  source 1..19: mol_type = other RNA
gccggcgaaagcggaccgc

SEQ ID NO: 481 - DNA, 19 bp, synthetic construct
  source 1..19: mol_type = other DNA
  misc_feature 1..6: note = RNA
  misc_feature 7: note = DNA
  misc_feature 8..9: note = RNA
  misc_feature 10: note = DNA
  misc_feature 11..12: note = RNA
  misc_feature 13: note = DNA
  misc_feature 14..19: note = RNA
ccgccctgctcctccgagc

SEQ ID NO: 482 - DNA, 19 bp, synthetic construct
  source 1..19: mol_type = other DNA
  misc_feature 1..7: note = RNA
  misc_feature 8: note = DNA
  misc_feature 9..19: note = RNA
ccaggcatcgccgcccggg

SEQ ID NO: 483 - DNA, 19 bp, synthetic construct
  source 1..19: mol_type = other DNA
  misc_feature 1..3: note = RNA
  misc_feature 4: note = DNA
  misc_feature 5..19: note = RNA
gcatcgccgcccgggagga

SEQ ID NO: 484 - DNA, 19 bp, synthetic construct
  source 1..19: mol_type = other DNA
  misc_feature 1..2: note = RNA
  misc_feature 3: note = DNA
  misc_feature 4..19: note = RNA
catcgccgcccgggaggag

SEQ ID NO: 485 - DNA, 19 bp, synthetic construct
  source 1..19: mol_type = other DNA
  misc_feature 1: note = RNA
  misc_feature 2: note = DNA
  misc_feature 3..19: note = RNA
atcgccgcccgggaggagc

SEQ ID NO: 486 - DNA, 19 bp, synthetic construct
  source 1..19: mol_type = other DNA
  misc_feature 1: note = DNA
  misc_feature 2..18: note = RNA
  misc_feature 19: note = DNA
tcgccgcccgggaggagct

SEQ ID NO: 487 - DNA, 19 bp, synthetic construct
  source 1..19: mol_type = other DNA
  misc_feature 1..17: note = RNA
  misc_feature 18: note = DNA
  misc_feature 19: note = RNA
cgccgcccgggaggagctg

SEQ ID NO: 488 - RNA, 19 nt, synthetic construct
  source 1..19: mol_type = other RNA
gggccaggcacccgggaca

SEQ ID NO: 489 - DNA, 19 bp, synthetic construct
  source 1..19: mol_type = other DNA
  misc_feature 1..7: note = RNA
  misc_feature 8: note = DNA
  misc_feature 9..19: note = RNA
gacagggtggcagggcgcc

SEQ ID NO: 490 - DNA, 19 bp, synthetic construct
  source 1..19: mol_type = other DNA
  misc_feature 1..6: note = RNA
  misc_feature 7: note = DNA
  misc_feature 8..19: note = RNA
acagggtggcagggcgccc

SEQ ID NO: 491 - DNA, 19 bp, synthetic construct
  source 1..19: mol_type = other DNA
  misc_feature 1..4: note = RNA
  misc_feature 5: note = DNA
  misc_feature 6..19: note = RNA
agggtggcagggcgcccgc

SEQ ID NO: 492 - DNA, 19 bp, synthetic construct
  source 1..19: mol_type = other DNA
  misc_feature 1..3: note = RNA
  misc_feature 4: note = DNA
  misc_feature 5..19: note = RNA
gggtggcagggcgcccgcg

SEQ ID NO: 493 - DNA, 19 bp, synthetic construct
  source 1..19: mol_type = other DNA
  misc_feature 1: note = RNA
  misc_feature 2: note = DNA
  misc_feature 3..19: note = RNA
gtggcagggcgcccgcgca

SEQ ID NO: 494 - DNA, 19 bp, synthetic construct
  source 1..19: mol_type = other DNA
  misc_feature 1..8: note = RNA
  misc_feature 9: note = DNA
  misc_feature 10: note = RNA
  misc_feature 11: note = DNA
  misc_feature 12..19: note = RNA
aggcggcctgtgcagcgcg

SEQ ID NO: 495 - DNA, 19 bp, synthetic construct
  source 1..19: mol_type = other DNA
  misc_feature 1..7: note = RNA
  misc_feature 8: note = DNA
  misc_feature 9: note = RNA
  misc_feature 10: note = DNA
  misc_feature 11..19: note = RNA
ggcggcctgtgcagcgcgg

SEQ ID NO: 496 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..19: note = RNA
gcggcctgtgcagcgcggc

SEQ ID NO: 497 - DNA, 19 bp, synthetic construct
  source 1..19: mol_type = other DNA
  misc_feature 1..4: note = RNA
  misc_feature 5..6: note = DNA
  misc_feature 7..19: note = RNA
cgccttcgcccacaccggc

SEQ ID NO: 498 - DNA, 19 bp, synthetic construct
  source 1..19: mol_type = other DNA
  misc_feature 1..10: note = RNA
  misc_feature 11: note = DNA
  misc_feature 12..19: note = RNA
caccggcgcgtggggaacg

SEQ ID NO: 499 - DNA, 19 bp, synthetic construct
  source 1..19: mol_type = other DNA
  misc_feature 1..9: note = RNA
  misc_feature 10: note = DNA
  misc_feature 11..19: note = RNA
accggcgcgtggggaacgg

SEQ ID NO: 500 - DNA, 19 bp, synthetic construct
  source 1..19: mol_type = other DNA
  misc_feature 1..8: note = RNA
  misc_feature 9: note = DNA
  misc_feature 10..19: note = RNA
ccggcgcgtggggaacggg

SEQ ID NO: 501 - DNA, 19 bp, synthetic construct
  source 1..19: mol_type = other DNA
  misc_feature 1..7: note = RNA
  misc_feature 8: note = DNA
  misc_feature 9..19: note = RNA
cggcgcgtggggaacgggg

SEQ ID NO: 502 - DNA, 19 bp, synthetic construct
  source 1..19: mol_type = other DNA
  misc_feature 1..5: note = RNA
  misc_feature 6: note = DNA
  misc_feature 7..18: note = RNA
  misc_feature 19: note = DNA
gcgcgtggggaacggggct

SEQ ID NO: 503 - DNA, 19 bp, synthetic construct
  source 1..19: mol_type = other DNA
  misc_feature 1..4: note = RNA
  misc_feature 5..6: note = DNA
  misc_feature 7..19: note = RNA
gggcttcccgcaccccacg

SEQ ID NO: 504 - DNA, 19 bp, synthetic construct
  source 1..19: mol_type = other DNA
  misc_feature 1..9: note = RNA
  misc_feature 10: note = DNA
  misc_feature 11..14: note = RNA
  misc_feature 15: note = DNA
  misc_feature 16..19: note = RNA
caccccacgtgccctgcgc

SEQ ID NO: 505 - DNA, 19 bp, synthetic construct
  source 1..19: mol_type = other DNA
  misc_feature 1..7: note = RNA
  misc_feature 8: note = DNA
  misc_feature 9..12: note = RNA
  misc_feature 13: note = DNA
  misc_feature 14..19: note = RNA
ccccacgtgccctgcgcgc

SEQ ID NO: 506 - DNA, 19 bp, synthetic construct
  source 1..19: mol_type = other DNA
  misc_feature 1..5: note = RNA
  misc_feature 6: note = DNA
  misc_feature 7..10: note = RNA
  misc_feature 11: note = DNA
  misc_feature 12..18: note = RNA
  misc_feature 19: note = DNA
ccacgtgccctgcgcgcct

SEQ ID NO: 507 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10..16: note = RNA
  misc_feature 17: note = DNA
  misc_feature 18..19: note = RNA
acgtgccctgcgcgcctgg

SEQ ID NO: 508 - DNA, 19 bp, synthetic construct
  source 1..19: mol_type = other DNA
  misc_feature 1: note = RNA
  misc_feature 2: note = DNA
  misc_feature 3..9: note = RNA
  misc_feature 10: note = DNA
  misc_feature 11..15: note = RNA
  misc_feature 16: note = DNA
  misc_feature 17: note = RNA
  misc_feature 18: note = DNA
  misc_feature 19: note = RNA
ctgcgcgcctggggctctc

SEQ ID NO: 509 - DNA, 19 bp, synthetic construct
  source 1..19: mol_type = other DNA
  misc_feature 1..2: note = RNA
  misc_feature 3..5: note = DNA
  misc_feature 6..7: note = RNA
  misc_feature 8: note = DNA
  misc_feature 9..19: note = RNA
gctttcgtgagccaggcag

SEQ ID NO: 510 - DNA, 19 bp, synthetic construct
  source 1..19: mol_type = other DNA
  misc_feature 1: note = RNA
  misc_feature 2..4: note = DNA
  misc_feature 5..6: note = RNA
  misc_feature 7: note = DNA
  misc_feature 8..19: note = RNA
ctttcgtgagccaggcagc

SEQ ID NO: 511 - DNA, 19 bp, synthetic construct
  source 1..19: mol_type = other DNA
  misc_feature 1..3: note = DNA
  misc_feature 4..5: note = RNA
  misc_feature 6: note = DNA
  misc_feature 7..19: note = RNA
tttcgtgagccaggcagcg

SEQ ID NO: 512 - RNA, 19 nt, synthetic construct
  source 1..19: mol_type = other RNA
ccaggcagcgagggccgcc

SEQ ID NO: 513 - DNA, 19 bp, synthetic construct
  source 1..19: mol_type = other DNA
  misc_feature 1: note = RNA
  misc_feature 2: note = DNA
  misc_feature 3..19: note = RNA
ctgcagcccagccaggccg

SEQ ID NO: 514 - RNA, 19 nt, synthetic construct
  source 1..19: mol_type = other RNA
gcagcccagccaggccgcg

SEQ ID NO: 515 - RNA, 19 nt, synthetic construct
  source 1..19: mol_type = other RNA
ccagccaggccgcgccggc

SEQ ID NO: 516 - DNA, 19 bp, synthetic construct
  source 1..19: mol_type = other DNA
  misc_feature 1..18: note = RNA
  misc_feature 19: note = DNA
ccgcgccggcagaggggat

SEQ ID NO: 517 - DNA, 19 bp, synthetic construct
  source 1..19: mol_type = other DNA
  misc_feature 1..6: note = RNA
  misc_feature 7: note = DNA
  misc_feature 8..19: note = RNA
ccaacctgccccggcgcgc

SEQ ID NO: 518 - DNA, 19 bp, synthetic construct
  source 1..19: mol_type = other DNA
  misc_feature 1..4: note = RNA
  misc_feature 5: note = DNA
  misc_feature 6..19: note = RNA
aacctgccccggcgcgcgg

SEQ ID NO: 519 - DNA, 19 bp, synthetic construct
  source 1..19: mol_type = other DNA
  misc_feature 1..9: note = RNA
  misc_feature 10..12: note = DNA
  misc_feature 13..16: note = RNA
  misc_feature 17: note = DNA
  misc_feature 18..19: note = RNA
gcgcggggatttcgcctac

SEQ ID NO: 520 - DNA, 19 bp, synthetic construct
  source 1..19: mol_type = other DNA
  misc_feature 1..2: note = DNA
  misc_feature 3..6: note = RNA
  misc_feature 7: note = DNA
  misc_feature 8..19: note = RNA
ttcgcctacgccgccccgg

SEQ ID NO: 521 - DNA, 19 bp, synthetic construct
  source 1..19: mol_type = other DNA
  misc_feature 1..4: note = RNA
  misc_feature 5: note = DNA
  misc_feature 6..18: note = RNA
  misc_feature 19: note = DNA
cgcctacgccgccccggct

SEQ ID NO: 522 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..19: note = RNA
ggctcctccggacggggcg

SEQ ID NO: 523 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..19: note = RNA
gctcctccggacggggcgc

SEQ ID NO: 524 - DNA, 19 bp, synthetic construct
  source 1..19: mol_type = other DNA
  misc_feature 1..7: note = RNA
  misc_feature 8: note = DNA
  misc_feature 9: note = RNA
  misc_feature 10: note = DNA
  misc_feature 11..17: note = RNA
  misc_feature 18: note = DNA
  misc_feature 19: note = RNA
ggggcgctctcccaccctc

SEQ ID NO: 525 - RNA, 19 nt, synthetic construct
  source 1..19: mol_type = other RNA
gaggaccgggacccgcagc

SEQ ID NO: 526 - RNA, 19 nt, synthetic construct
  source 1..19: mol_type = other RNA
gggacccgcagcgcgacgg

SEQ ID NO: 527 - DNA, 19 bp, synthetic construct
  source 1..19: mol_type = other DNA
  misc_feature 1..17: note = RNA
  misc_feature 18: note = DNA
  misc_feature 19: note = RNA
cccgcagcgcgacggcctg

SEQ ID NO: 528 - DNA, 19 bp, synthetic construct
  source 1..19: mol_type = other DNA
  misc_feature 1..3: note = RNA
  misc_feature 4: note = DNA
  misc_feature 5..14: note = RNA
  misc_feature 15: note = DNA
  misc_feature 16..19: note = RNA
gcctgccgggcccctgcgc

SEQ ID NO: 529 - DNA, 19 bp, synthetic construct
  source 1..19: mol_type = other DNA
  misc_feature 1..2: note = RNA
  misc_feature 3: note = DNA
  misc_feature 4..9: note = RNA
  misc_feature 10: note = DNA
  misc_feature 11..19: note = RNA
cctgcgcggtggcacagcc

SEQ ID NO: 530 - DNA, 19 bp, synthetic construct
  source 1..19: mol_type = other DNA
  misc_feature 1..6: note = RNA
  misc_feature 7: note = DNA
  misc_feature 8..16: note = RNA
  misc_feature 17: note = DNA
  misc_feature 18..19: note = RNA
gcgcggtggcacagcctgg

SEQ ID NO: 531 - DNA, 19 bp, synthetic construct
  source 1..19: mol_type = other DNA
  misc_feature 1..5: note = RNA
  misc_feature 6: note = DNA
  misc_feature 7..15: note = RNA
  misc_feature 16: note = DNA
  misc_feature 17..19: note = RNA
cgcggtggcacagcctggg

SEQ ID NO: 532 - DNA, 19 bp, synthetic construct
  source 1..19: mol_type = other DNA
  misc_feature 1..3: note = RNA
  misc_feature 4: note = DNA
  misc_feature 5..13: note = RNA
  misc_feature 14: note = DNA
  misc_feature 15..19: note = RNA
cggtggcacagcctgggcc

SEQ ID NO: 533 - DNA, 19 bp, synthetic construct
  source 1..19: mol_type = other DNA
  misc_feature 1..8: note = RNA
  misc_feature 9: note = DNA
  misc_feature 10..17: note = RNA
  misc_feature 18: note = DNA
  misc_feature 19: note = RNA
gcacagcctgggcccgctc

SEQ ID NO: 534 - DNA, 19 bp, synthetic construct
  source 1..19: mol_type = other DNA
  misc_feature 1..2: note = RNA
  misc_feature 3: note = DNA
  misc_feature 4..11: note = RNA
  misc_feature 12: note = DNA
  misc_feature 13..19: note = RNA
cctgggcccgctcaagcgg

SEQ ID NO: 535 - DNA, 19 bp, synthetic construct
  source 1..19: mol_type = other DNA
  misc_feature 1..16: note = RNA
  misc_feature 17: note = DNA
  misc_feature 18..19: note = RNA
ccgcagggccaaggggtgc

SEQ ID NO: 536 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5..6: note = DNA
  misc_feature 7..18: note = RNA
  misc_feature 19: note = DNA
gtgcttgcgccacccacgt

SEQ ID NO: 537 - DNA, 19 bp, synthetic construct
  source 1..19: mol_type = other DNA
  misc_feature 1: note = DNA
  misc_feature 2..3: note = RNA
  misc_feature 4..5: note = DNA
  misc_feature 6..17: note = RNA
  misc_feature 18: note = DNA
  misc_feature 19: note = RNA
tgcttgcgccacccacgtc

SEQ ID NO: 538 - DNA, 19 bp, synthetic construct
  source 1..19: mol_type = other DNA
  misc_feature 1..2: note = RNA
  misc_feature 3..4: note = DNA
  misc_feature 5..16: note = RNA
  misc_feature 17: note = DNA
  misc_feature 18..19: note = RNA
gcttgcgccacccacgtcc

SEQ ID NO: 539 - DNA, 19 bp, synthetic construct
  source 1..19: mol_type = other DNA
  misc_feature 1: note = RNA
  misc_feature 2..3: note = DNA
  misc_feature 4..15: note = RNA
  misc_feature 16: note = DNA
  misc_feature 17..19: note = RNA
cttgcgccacccacgtccc

SEQ ID NO: 540 - DNA, 19 bp, synthetic construct
  source 1..19: mol_type = other DNA
  misc_feature 1: note = DNA
  misc_feature 2..13: note = RNA
  misc_feature 14: note = DNA
  misc_feature 15..19: note = RNA
tgcgccacccacgtcccag

SEQ ID NO: 541 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..9: note = RNA
  misc_feature 10: note = DNA
  misc_feature 11..15: note = RNA
  misc_feature 16: note = DNA
  misc_feature 17..19: note = RNA
agtccgtggtggggctggg

SEQ ID NO: 542 - DNA, 19 bp, synthetic construct
  source 1..19: mol_type = other DNA
  misc_feature 1..9: note = RNA
  misc_feature 10: note = DNA
  misc_feature 11..17: note = RNA
  misc_feature 18: note = DNA
  misc_feature 19: note = RNA
gggccggggtccccaggtc

SEQ ID NO: 543 - DNA, 19 bp, synthetic construct
  source 1..19: mol_type = other DNA
  misc_feature 1..6: note = RNA
  misc_feature 7: note = DNA
  misc_feature 8..14: note = RNA
  misc_feature 15: note = DNA
  misc_feature 16..19: note = RNA
ccggggtccccaggtcgcc

SEQ ID NO: 544 - DNA, 19 bp, synthetic construct
  source 1..19: mol_type = other DNA
  misc_feature 1..11: note = RNA
  misc_feature 12: note = DNA
  misc_feature 13..19: note = RNA
ccggggcggcgtgggaacc

SEQ ID NO: 545 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8: note = DNA
  misc_feature 9..19: note = RNA
ctccacctccccagcccgc

SEQ ID NO: 546 - DNA, 19 bp, synthetic construct
  source 1..19: mol_type = other DNA
  misc_feature 1..4: note = RNA
  misc_feature 5: note = DNA
  misc_feature 6..19: note = RNA
cacctccccagcccgcgcc

SEQ ID NO: 547 - DNA, 19 bp, synthetic construct
  source 1..19: mol_type = other DNA
  misc_feature 1..2: note = RNA
  misc_feature 3: note = DNA
  misc_feature 4..19: note = RNA
cctccccagcccgcgcccc

SEQ ID NO: 548 - DNA, 19 bp, synthetic construct
  source 1..19: mol_type = other DNA
  misc_feature 1..4: note = RNA
  misc_feature 5: note = DNA
  misc_feature 6..19: note = RNA
cgcctccgcgcggcagggg

SEQ ID NO: 549 - DNA, 19 bp, synthetic construct
  source 1..19: mol_type = other DNA
  misc_feature 1..18: note = RNA
  misc_feature 19: note = DNA
ccgcgcggcaggggcagat

SEQ ID NO: 550 - DNA, 19 bp, synthetic construct
  source 1..19: mol_type = other DNA
  misc_feature 1..16: note = RNA
  misc_feature 17: note = DNA
  misc_feature 18..19: note = RNA
gcgcggcaggggcagatgc

SEQ ID NO: 551 - DNA, 19 bp, synthetic construct
  source 1..19: mol_type = other DNA
  misc_feature 1..9: note = RNA
  misc_feature 10: note = DNA
  misc_feature 11..19: note = RNA
cccaggcgctccaggagcc

SEQ ID NO: 552 - DNA, 19 bp, synthetic construct
  source 1..19: mol_type = other DNA
  misc_feature 1..12: note = RNA
  misc_feature 13: note = DNA
  misc_feature 14..15: note = RNA
  misc_feature 16: note = DNA
  misc_feature 17: note = RNA
  misc_feature 18: note = DNA
  misc_feature 19: note = RNA
gagccggcgccctggtctg

SEQ ID NO: 553 - DNA, 19 bp, synthetic construct
  source 1..19: mol_type = other DNA
  misc_feature 1..10: note = RNA
  misc_feature 11: note = DNA
  misc_feature 12..13: note = RNA
  misc_feature 14: note = DNA
  misc_feature 15: note = RNA
  misc_feature 16: note = DNA
  misc_feature 17..19: note = RNA
gccggcgccctggtctgca

SEQ ID NO: 554 - DNA, 19 bp, synthetic construct
  source 1..19: mol_type = other DNA
  misc_feature 1..9: note = RNA
  misc_feature 10: note = DNA
  misc_feature 11..12: note = RNA
  misc_feature 13: note = DNA
  misc_feature 14: note = RNA
  misc_feature 15: note = DNA
  misc_feature 16..19: note = RNA
ccggcgccctggtctgcac

SEQ ID NO: 555 - DNA, 19 bp, synthetic construct
  source 1..19: mol_type = other DNA
  misc_feature 1..8: note = RNA
  misc_feature 9: note = DNA
  misc_feature 10..11: note = RNA
  misc_feature 12: note = DNA
  misc_feature 13: note = RNA
  misc_feature 14: note = DNA
  misc_feature 15..18: note = RNA
  misc_feature 19: note = DNA
cggcgccctggtctgcact

SEQ ID NO: 556 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..13: note = RNA
  misc_feature 14: note = DNA
  misc_feature 15..16: note = RNA
  misc_feature 17: note = DNA
  misc_feature 18..19: note = RNA
ctcccctgcggcctgctgc

SEQ ID NO: 557 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..10: note = RNA
  misc_feature 11: note = DNA
  misc_feature 12..13: note = RNA
  misc_feature 14: note = DNA
  misc_feature 15..19: note = RNA
ctggatgagctcctggcga

SEQ ID NO: 558 - DNA, 19 bp, synthetic construct
  source 1..19: mol_type = other DNA
  misc_feature 1..7: note = RNA
  misc_feature 8: note = DNA
  misc_feature 9..15: note = RNA
  misc_feature 16: note = DNA
  misc_feature 17..19: note = RNA
ggggagctggaggcctcgg

SEQ ID NO: 559 - DNA, 19 bp, synthetic construct
  source 1..19: mol_type = other DNA
  misc_feature 1..4: note = RNA
  misc_feature 5: note = DNA
  misc_feature 6..12: note = RNA
  misc_feature 13: note = DNA
  misc_feature 14..19: note = RNA
gagctggaggcctcggaag

SEQ ID NO: 560 - DNA, 19 bp, synthetic construct
  source 1..19: mol_type = other DNA
  misc_feature 1..3: note = RNA
  misc_feature 4: note = DNA
  misc_feature 5..11: note = RNA
  misc_feature 12: note = DNA
  misc_feature 13..19: note = RNA
agctggaggcctcggaaga

SEQ ID NO: 561 - DNA, 19 bp, synthetic construct
  source 1..19: mol_type = other DNA
  misc_feature 1..2: note = RNA
  misc_feature 3: note = DNA
  misc_feature 4..10: note = RNA
  misc_feature 11: note = DNA
  misc_feature 12..19: note = RNA
gctggaggcctcggaagag

SEQ ID NO: 562 - DNA, 19 bp, synthetic construct
  source 1..19: mol_type = other DNA
  misc_feature 1..7: note = RNA
  misc_feature 8: note = DNA
  misc_feature 9..11: note = RNA
  misc_feature 12: note = DNA
  misc_feature 13..19: note = RNA
ggccgcctcgctggaagca

SEQ ID NO: 563 - DNA, 19 bp, synthetic construct
  source 1..19: mol_type = other DNA
  misc_feature 1..6: note = RNA
  misc_feature 7: note = DNA
  misc_feature 8..10: note = RNA
  misc_feature 11: note = DNA
  misc_feature 12..19: note = RNA
gccgcctcgctggaagcac

SEQ ID NO: 564 - DNA, 19 bp, synthetic construct
  source 1..19: mol_type = other DNA
  misc_feature 1..5: note = RNA
  misc_feature 6: note = DNA
  misc_feature 7..9: note = RNA
  misc_feature 10: note = DNA
  misc_feature 11..19: note = RNA
ccgcctcgctggaagcacc

SEQ ID NO: 565 - DNA, 19 bp, synthetic construct
  source 1..19: mol_type = other DNA
  misc_feature 1..4: note = RNA
  misc_feature 5: note = DNA
  misc_feature 6..8: note = RNA
  misc_feature 9: note = DNA
  misc_feature 10..19: note = RNA
cgcctcgctggaagcaccc

SEQ ID NO: 566 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8: note = DNA
  misc_feature 9..19: note = RNA
gcctcgctggaagcacccc

SEQ ID NO: 567 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..17: note = RNA
  misc_feature 18: note = DNA
  misc_feature 19: note = RNA
ctcgctggaagcacccctc

SEQ ID NO: 568 - DNA, 19 bp, synthetic construct
  source 1..19: mol_type = other DNA
  misc_feature 1: note = RNA
  misc_feature 2: note = DNA
  misc_feature 3..15: note = RNA
  misc_feature 16: note = DNA
  misc_feature 17..19: note = RNA
ctcagcgaggaagaatacc

SEQ ID NO: 569 - DNA, 19 bp, synthetic construct
  source 1..19: mol_type = other DNA
  misc_feature 1: note = DNA
  misc_feature 2..14: note = RNA
  misc_feature 15: note = DNA
  misc_feature 16..19: note = RNA
tcagcgaggaagaataccg

SEQ ID NO: 570 - DNA, 19 bp, synthetic construct
  source 1..19: mol_type = other DNA
  misc_feature 1..7: note = RNA
  misc_feature 8: note = DNA
  misc_feature 9..15: note = RNA
  misc_feature 16: note = DNA
  misc_feature 17: note = RNA
  misc_feature 18: note = DNA
  misc_feature 19: note = RNA
ggaagaataccgggctctg

SEQ ID NO: 571 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..11: note = RNA
  misc_feature 12: note = DNA
  misc_feature 13..19: note = RNA
ccgggctctgctggaggag

SEQ ID NO: 572 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..5: note = RNA
  misc_feature 6: note = DNA
  misc_feature 7..14: note = RNA
  misc_feature 15..17: note = DNA
  misc_feature 18..19: note = RNA
tctgctggaggagctttag

SEQ ID NO: 573 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..13: note = RNA
  misc_feature 14..16: note = DNA
  misc_feature 17..19: note = RNA
ctgctggaggagctttagg

SEQ ID NO: 574 - DNA, 19 bp, synthetic construct
  source 1..19: mol_type = other DNA
  misc_feature 1..2: note = RNA
  misc_feature 3: note = DNA
  misc_feature 4..11: note = RNA
  misc_feature 12..14: note = DNA
  misc_feature 15..19: note = RNA
gctggaggagctttaggac

SEQ ID NO: 575 - DNA, 19 bp, synthetic construct
  source 1..19: mol_type = other DNA
  misc_feature 1: note = RNA
  misc_feature 2: note = DNA
  misc_feature 3..10: note = RNA
  misc_feature 11..13: note = DNA
  misc_feature 14..19: note = RNA
ctggaggagctttaggacg

SEQ ID NO: 576 - DNA, 19 bp, synthetic construct
  source 1..19: mol_type = other DNA
  misc_feature 1..6: note = RNA
  misc_feature 7..9: note = DNA
  misc_feature 10..19: note = RNA
aggagctttaggacgcggg

SEQ ID NO: 577 - DNA, 19 bp, synthetic construct
  source 1..19: mol_type = other DNA
  misc_feature 1..5: note = RNA
  misc_feature 6..8: note = DNA
  misc_feature 9..19: note = RNA
ggagctttaggacgcgggg

SEQ ID NO: 578 - DNA, 19 bp, synthetic construct
  source 1..19: mol_type = other DNA
  misc_feature 1..4: note = RNA
  misc_feature 5..7: note = DNA
  misc_feature 8..18: note = RNA
  misc_feature 19: note = DNA
gagctttaggacgcggggt

SEQ ID NO: 579 - DNA, 19 bp, synthetic construct
  source 1..19: mol_type = other DNA
  misc_feature 1..3: note = RNA
  misc_feature 4..6: note = DNA
  misc_feature 7..17: note = RNA
  misc_feature 18..19: note = DNA
agctttaggacgcggggtt

SEQ ID NO: 580 - DNA, 19 bp, synthetic construct
  source 1..19: mol_type = other DNA
  misc_feature 1..2: note = RNA
  misc_feature 3..5: note = DNA
  misc_feature 6..16: note = RNA
  misc_feature 17..18: note = DNA
  misc_feature 19: note = RNA
gctttaggacgcggggttg

SEQ ID NO: 581 - DNA, 19 bp, synthetic construct
  source 1..19: mol_type = other DNA
  misc_feature 1: note = RNA
  misc_feature 2..4: note = DNA
  misc_feature 5..15: note = RNA
  misc_feature 16..17: note = DNA
  misc_feature 18..19: note = RNA
ctttaggacgcggggttgg

SEQ ID NO: 582 - DNA, 19 bp, synthetic construct
  source 1..19: mol_type = other DNA
  misc_feature 1..3: note = DNA
  misc_feature 4..14: note = RNA
  misc_feature 15..16: note = DNA
  misc_feature 17..19: note = RNA
tttaggacgcggggttggg

SEQ ID NO: 583 - DNA, 19 bp, synthetic construct
  source 1..19: mol_type = other DNA
  misc_feature 1..2: note = DNA
  misc_feature 3..13: note = RNA
  misc_feature 14..15: note = DNA
  misc_feature 16..19: note = RNA
ttaggacgcggggttggga

SEQ ID NO: 584 - DNA, 19 bp, synthetic construct
  source 1..19: mol_type = other DNA
  misc_feature 1..11: note = RNA
  misc_feature 12..13: note = DNA
  misc_feature 14..19: note = RNA
aggacgcggggttgggacg

SEQ ID NO: 585 - DNA, 19 bp, synthetic construct
  source 1..19: mol_type = other DNA
  misc_feature 1..6: note = RNA
  misc_feature 7..8: note = DNA
  misc_feature 9..17: note = RNA
  misc_feature 18: note = DNA
  misc_feature 19: note = RNA
gcggggttgggacggggtc

SEQ ID NO: 586 - DNA, 19 bp, synthetic construct
  source 1..19: mol_type = other DNA
  misc_feature 1: note = RNA
  misc_feature 2..3: note = DNA
  misc_feature 4..12: note = RNA
  misc_feature 13: note = DNA
  misc_feature 14..17: note = RNA
  misc_feature 18: note = DNA
  misc_feature 19: note = RNA
gttgggacggggtcgggtg

SEQ ID NO: 587 - DNA, 19 bp, synthetic construct
  source 1..19: mol_type = other DNA
  misc_feature 1..8: note = RNA
  misc_feature 9: note = DNA
  misc_feature 10..13: note = RNA
  misc_feature 14: note = DNA
  misc_feature 15..16: note = RNA
  misc_feature 17..18: note = DNA
  misc_feature 19: note = RNA
ggacggggtcgggtggttc

SEQ ID NO: 588 - DNA, 19 bp, synthetic construct
  source 1..19: mol_type = other DNA
  misc_feature 1..3: note = RNA
  misc_feature 4: note = DNA
  misc_feature 5..12: note = RNA
  misc_feature 13: note = DNA
  misc_feature 14..17: note = RNA
  misc_feature 18..19: note = DNA
ggctgaccggcctgggatt

SEQ ID NO: 589 - DNA, 19 bp, synthetic construct
  source 1..19: mol_type = other DNA
  misc_feature 1..2: note = RNA
  misc_feature 3: note = DNA
  misc_feature 4..11: note = RNA
  misc_feature 12: note = DNA
  misc_feature 13..16: note = RNA
  misc_feature 17..18: note = DNA
  misc_feature 19: note = RNA
gctgaccggcctgggattc

SEQ ID NO: 590 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7..8: note = DNA
  misc_feature 9..10: note = RNA
  misc_feature 11: note = DNA
  misc_feature 12..14: note = RNA
  misc_feature 15..16: note = DNA
  misc_feature 17: note = RNA
  misc_feature 18: note = DNA
  misc_feature 19: note = RNA
ctgggattcctgccttcta

SEQ ID NO: 591 - DNA, 19 bp, synthetic construct
  source 1..19: mol_type = other DNA
  misc_feature 1: note = DNA
  misc_feature 2..5: note = RNA
  misc_feature 6..7: note = DNA
  misc_feature 8..9: note = RNA
  misc_feature 10: note = DNA
  misc_feature 11..13: note = RNA
  misc_feature 14..15: note = DNA
  misc_feature 16: note = RNA
  misc_feature 17: note = DNA
  misc_feature 18..19: note = RNA
tgggattcctgccttctag

SEQ ID NO: 592 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..13: note = RNA
  misc_feature 14: note = DNA
  misc_feature 15..19: note = RNA
ggtctaggcccggtgagag

SEQ ID NO: 593 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..12: note = RNA
  misc_feature 13: note = DNA
  misc_feature 14..19: note = RNA
gtctaggcccggtgagaga

SEQ ID NO: 594 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..11: note = RNA
  misc_feature 12: note = DNA
  misc_feature 13..19: note = RNA
tctaggcccggtgagagac

SEQ ID NO: 595 - DNA, 19 bp, synthetic construct
  source 1..19: mol_type = other DNA
  misc_feature 1: note = RNA
  misc_feature 2: note = DNA
  misc_feature 3..10: note = RNA
  misc_feature 11: note = DNA
  misc_feature 12..18: note = RNA
  misc_feature 19: note = DNA
ctaggcccggtgagagact

SEQ ID NO: 596 - DNA, 19 bp, synthetic construct
  source 1..19: mol_type = other DNA
  misc_feature 1..7: note = RNA
  misc_feature 8: note = DNA
  misc_feature 9..15: note = RNA
  misc_feature 16: note = DNA
  misc_feature 17..19: note = RNA
ggcccggtgagagactcca

SEQ ID NO: 597 - DNA, 19 bp, synthetic construct
  source 1..19: mol_type = other DNA
  misc_feature 1..6: note = RNA
  misc_feature 7: note = DNA
  misc_feature 8..14: note = RNA
  misc_feature 15: note = DNA
  misc_feature 16..19: note = RNA
gcccggtgagagactccac

SEQ ID NO: 598 - DNA, 19 bp, synthetic construct
  source 1..19: mol_type = other DNA
  misc_feature 1..5: note = RNA
  misc_feature 6: note = DNA
  misc_feature 7..13: note = RNA
  misc_feature 14: note = DNA
  misc_feature 15..18: note = RNA
  misc_feature 19: note = DNA
cccggtgagagactccact

SEQ ID NO: 599 - DNA, 19 bp, synthetic construct
  source 1..19: mol_type = other DNA
  misc_feature 1..7: note = RNA
  misc_feature 8..9: note = DNA
  misc_feature 10..16: note = RNA
  misc_feature 17: note = DNA
  misc_feature 18: note = RNA
  misc_feature 19: note = DNA
ccccaccttccgacgctgt

SEQ ID NO: 600 - DNA, 19 bp, synthetic construct
  source 1..19: mol_type = other DNA
  misc_feature 1..6: note = RNA
  misc_feature 7..8: note = DNA
  misc_feature 9..15: note = RNA
  misc_feature 16: note = DNA
  misc_feature 17: note = RNA
  misc_feature 18: note = DNA
  misc_feature 19: note = RNA
cccaccttccgacgctgtc

SEQ ID NO: 601 - DNA, 19 bp, synthetic construct
  source 1..19: mol_type = other DNA
  misc_feature 1..2: note = RNA
  misc_feature 3..4: note = DNA
  misc_feature 5..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..19: note = RNA
ccttccgacgctgtctagg

SEQ ID NO: 602 - DNA, 19 bp, synthetic construct
  source 1..19: mol_type = other DNA
  misc_feature 1: note = RNA
  misc_feature 2..3: note = DNA
  misc_feature 4..10: note = RNA
  misc_feature 11: note = DNA
  misc_feature 12: note = RNA
  misc_feature 13: note = DNA
  misc_feature 14: note = RNA
  misc_feature 15: note = DNA
  misc_feature 16..19: note = RNA
cttccgacgctgtctaggc

SEQ ID NO: 603 - DNA, 19 bp, synthetic construct
  source 1..19: mol_type = other DNA
  misc_feature 1..2: note = DNA
  misc_feature 3..9: note = RNA
  misc_feature 10: note = DNA
  misc_feature 11: note = RNA
  misc_feature 12: note = DNA
  misc_feature 13: note = RNA
  misc_feature 14: note = DNA
  misc_feature 15..19: note = RNA
ttccgacgctgtctaggca

SEQ ID NO: 604 - DNA, 19 bp, synthetic construct
  source 1..19: mol_type = other DNA
  misc_feature 1: note = DNA
  misc_feature 2..8: note = RNA
  misc_feature 9: note = DNA
  misc_feature 10: note = RNA
  misc_feature 11: note = DNA
  misc_feature 12: note = RNA
  misc_feature 13: note = DNA
  misc_feature 14..19: note = RNA
tccgacgctgtctaggcaa

SEQ ID NO: 605 - DNA, 19 bp, synthetic construct
  source 1..19: mol_type = other DNA
  misc_feature 1..7: note = RNA
  misc_feature 8: note = DNA
  misc_feature 9: note = RNA
  misc_feature 10: note = DNA
  misc_feature 11: note = RNA
  misc_feature 12: note = DNA
  misc_feature 13..19: note = RNA
ccgacgctgtctaggcaaa

SEQ ID NO: 606 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10: note = RNA
  misc_feature 11: note = DNA
  misc_feature 12..19: note = RNA
cgacgctgtctaggcaaac

SEQ ID NO: 607 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..18: note = RNA
  misc_feature 19: note = DNA
agggtgtcgggagggccat

SEQ ID NO: 608 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..19: note = RNA
gagggtgtcgggagggcca

SEQ ID NO: 609 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..14: note = RNA
  misc_feature 15: note = DNA
  misc_feature 16: note = RNA
  misc_feature 17: note = DNA
  misc_feature 18..19: note = RNA
gtgctgtccgagggtgtcg

SEQ ID NO: 610 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7: note = RNA
  misc_feature 8: note = DNA
  misc_feature 9..15: note = RNA
  misc_feature 16: note = DNA
  misc_feature 17: note = RNA
  misc_feature 18: note = DNA
  misc_feature 19: note = RNA
ggtgctgtccgagggtgtc

SEQ ID NO: 611 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8: note = RNA
  misc_feature 9: note = DNA
  misc_feature 10..16: note = RNA
  misc_feature 17: note = DNA
  misc_feature 18: note = RNA
  misc_feature 19: note = DNA
gggtgctgtccgagggtgt

SEQ ID NO: 612 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8: note = DNA
  misc_feature 9: note = RNA
  misc_feature 10: note = DNA
  misc_feature 11..17: note = RNA
  misc_feature 18: note = DNA
  misc_feature 19: note = RNA
agggtgctgtccgagggtg

SEQ ID NO: 613 - DNA, 19 bp, synthetic construct
  source 1..19: mol_type = other DNA
  misc_feature 1..5: note = RNA
  misc_feature 6: note = DNA
  misc_feature 7..8: note = RNA
  misc_feature 9: note = DNA
  misc_feature 10: note = RNA
  misc_feature 11: note = DNA
  misc_feature 12..18: note = RNA
  misc_feature 19: note = DNA
gagggtgctgtccgagggt

SEQ ID NO: 614 - DNA, 19 bp, synthetic construct
  source 1..19: mol_type = other DNA
  misc_feature 1..6: note = RNA
  misc_feature 7: note = DNA
  misc_feature 8..9: note = RNA
  misc_feature 10: note = DNA
  misc_feature 11: note = RNA
  misc_feature 12: note = DNA
  misc_feature 13..19: note = RNA
ggagggtgctgtccgaggg

SEQ ID NO: 615 - DNA, 19 bp, synthetic construct
  source 1..19: mol_type = other DNA
  misc_feature 1..7: note = RNA
  misc_feature 8: note = DNA
  misc_feature 9..10: note = RNA
  misc_feature 11: note = DNA
  misc_feature 12: note = RNA
  misc_feature 13: note = DNA
  misc_feature 14..19: note = RNA
gggagggtgctgtccgagg

SEQ ID NO: 616 - DNA, 19 bp, synthetic construct
  source 1..19: mol_type = other DNA
  misc_feature 1..8: note = RNA
  misc_feature 9: note = DNA
  misc_feature 10..11: note = RNA
  misc_feature 12: note = DNA
  misc_feature 13: note = RNA
  misc_feature 14: note = DNA
  misc_feature 15..19: note = RNA
ggggagggtgctgtccgag

SEQ ID NO: 617 - DNA, 19 bp, synthetic construct
  source 1..19: mol_type = other DNA
  misc_feature 1..9: note = RNA
  misc_feature 10: note = DNA
  misc_feature 11..12: note = RNA
  misc_feature 13: note = DNA
  misc_feature 14: note = RNA
  misc_feature 15: note = DNA
  misc_feature 16..19: note = RNA
cggggagggtgctgtccga

SEQ ID NO: 618 - DNA, 19 bp, synthetic construct
  source 1..19: mol_type = other DNA
  misc_feature 1: note = DNA
  misc_feature 2..13: note = RNA
  misc_feature 14: note = DNA
  misc_feature 15..16: note = RNA
  misc_feature 17: note = DNA
  misc_feature 18: note = RNA
  misc_feature 19: note = DNA
tccgcggggagggtgctgt

SEQ ID NO: 619 - DNA, 19 bp, synthetic construct
  source 1..19: mol_type = other DNA
  misc_feature 1..2: note = DNA
  misc_feature 3..14: note = RNA
  misc_feature 15: note = DNA
  misc_feature 16..17: note = RNA
  misc_feature 18: note = DNA
  misc_feature 19: note = RNA
ttccgcggggagggtgctg

SEQ ID NO: 620 - DNA, 19 bp, synthetic construct
  source 1..19: mol_type = other DNA
  misc_feature 1: note = RNA
  misc_feature 2..3: note = DNA
  misc_feature 4..15: note = RNA
  misc_feature 16: note = DNA
  misc_feature 17..18: note = RNA
  misc_feature 19: note = DNA
cttccgcggggagggtgct

SEQ ID NO: 621 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..6: note = RNA
  misc_feature 7: note = DNA
  misc_feature 8..15: note = RNA
  misc_feature 16..17: note = DNA
  misc_feature 18..19: note = RNA
tcctcgtccccgggcttcc

SEQ ID NO: 622 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..7: note = RNA
  misc_feature 8: note = DNA
  misc_feature 9..16: note = RNA
  misc_feature 17..18: note = DNA
  misc_feature 19: note = RNA
gtcctcgtccccgggcttc

SEQ ID NO: 623 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..8: note = RNA
  misc_feature 9: note = DNA
  misc_feature 10..17: note = RNA
  misc_feature 18..19: note = DNA
cgtcctcgtccccgggctt

SEQ ID NO: 624 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..10: note = RNA
  misc_feature 11: note = DNA
  misc_feature 12..13: note = RNA
  misc_feature 14: note = DNA
  misc_feature 15..16: note = RNA
  misc_feature 17: note = DNA
  misc_feature 18..19: note = RNA
tccgtcgccgtcctcgtcc

SEQ ID NO: 625 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..11: note = RNA
  misc_feature 12: note = DNA
  misc_feature 13..14: note = RNA
  misc_feature 15: note = DNA
  misc_feature 16..17: note = RNA
  misc_feature 18: note = DNA
  misc_feature 19: note = RNA
ctccgtcgccgtcctcgtc

SEQ ID NO: 626 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..6: note = RNA
  misc_feature 7: note = DNA
  misc_feature 8..12: note = RNA
  misc_feature 13: note = DNA
  misc_feature 14..15: note = RNA
  misc_feature 16: note = DNA
  misc_feature 17..18: note = RNA
  misc_feature 19: note = DNA
tctccgtcgccgtcctcgt

SEQ ID NO: 627 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..7: note = RNA
  misc_feature 8: note = DNA
  misc_feature 9..13: note = RNA
  misc_feature 14: note = DNA
  misc_feature 15..16: note = RNA
  misc_feature 17: note = DNA
  misc_feature 18..19: note = RNA
gtctccgtcgccgtcctcg

SEQ ID NO: 628 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..8: note = RNA
  misc_feature 9: note = DNA
  misc_feature 10..14: note = RNA
  misc_feature 15: note = DNA
  misc_feature 16..17: note = RNA
  misc_feature 18: note = DNA
  misc_feature 19: note = RNA
agtctccgtcgccgtcctc

SEQ ID NO: 629 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..9: note = RNA
  misc_feature 10: note = DNA
  misc_feature 11..15: note = RNA
  misc_feature 16: note = DNA
  misc_feature 17..18: note = RNA
  misc_feature 19: note = DNA
gagtctccgtcgccgtcct

SEQ ID NO: 630 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..10: note = RNA
  misc_feature 11: note = DNA
  misc_feature 12..16: note = RNA
  misc_feature 17: note = DNA
  misc_feature 18..19: note = RNA
cgagtctccgtcgccgtcc

SEQ ID NO: 631 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..11: note = RNA
  misc_feature 12: note = DNA
  misc_feature 13..17: note = RNA
  misc_feature 18: note = DNA
  misc_feature 19: note = RNA
acgagtctccgtcgccgtc

SEQ ID NO: 632 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..12: note = RNA
  misc_feature 13: note = DNA
  misc_feature 14..18: note = RNA
  misc_feature 19: note = DNA
aacgagtctccgtcgccgt

SEQ ID NO: 633 - DNA, 19 bp, synthetic construct
  source 1..19: mol_type = other DNA
  misc_feature 1..9: note = RNA
  misc_feature 10: note = DNA
  misc_feature 11: note = RNA
  misc_feature 12: note = DNA
  misc_feature 13..15: note = RNA
  misc_feature 16: note = DNA
  misc_feature 17..19: note = RNA
ccaaacgagtctccgtcgc

SEQ ID NO: 634 - DNA, 19 bp, synthetic construct
  source 1..19: mol_type = other DNA
  misc_feature 1: note = DNA
  misc_feature 2..10: note = RNA
  misc_feature 11: note = DNA
  misc_feature 12: note = RNA
  misc_feature 13: note = DNA
  misc_feature 14..16: note = RNA
  misc_feature 17: note = DNA
  misc_feature 18..19: note = RNA
tccaaacgagtctccgtcg

SEQ ID NO: 635 - DNA, 19 bp, synthetic construct
  source 1..19: mol_type = other DNA
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..17: note = RNA
  misc_feature 18: note = DNA
  misc_feature 19: note = RNA
gtccaaacgagtctccgtc

SEQ ID NO: 636 - DNA, 19 bp, synthetic construct
  source 1..19: mol_type = other DNA
  misc_feature 1..2: note = RNA
  misc_feature 3: note = DNA
  misc_feature 4..12: note = RNA
  misc_feature 13: note = DNA
  misc_feature 14: note = RNA
  misc_feature 15: note = DNA
  misc_feature 16..18: note = RNA
  misc_feature 19: note = DNA
ggtccaaacgagtctccgt

SEQ ID NO: 637 - DNA, 19 bp, synthetic construct
  source 1..19: mol_type = other DNA
  misc_feature 1..3: note = RNA
  misc_feature 4: note = DNA
  misc_feature 5..13: note = RNA
  misc_feature 14: note = DNA
  misc_feature 15: note = RNA
  misc_feature 16: note = DNA
  misc_feature 17..19: note = RNA
gggtccaaacgagtctccg

SEQ ID NO: 638 - DNA, 19 bp, synthetic construct
  source 1..19: mol_type = other DNA
  misc_feature 1..4: note = RNA
  misc_feature 5: note = DNA
  misc_feature 6..14: note = RNA
  misc_feature 15: note = DNA
  misc_feature 16: note = RNA
  misc_feature 17: note = DNA
  misc_feature 18..19: note = RNA
ggggtccaaacgagtctcc

SEQ ID NO: 639 - DNA, 19 bp, synthetic construct
  source 1..19: mol_type = other DNA
  misc_feature 1..5: note = RNA
  misc_feature 6: note = DNA
  misc_feature 7..15: note = RNA
  misc_feature 16: note = DNA
  misc_feature 17: note = RNA
  misc_feature 18: note = DNA
  misc_feature 19: note = RNA
cggggtccaaacgagtctc

SEQ ID NO: 640 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..16: note = RNA
  misc_feature 17: note = DNA
  misc_feature 18: note = RNA
  misc_feature 19: note = DNA
tcggggtccaaacgagtct

SEQ ID NO: 641 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..10: note = RNA
  misc_feature 11: note = DNA
  misc_feature 12..19: note = RNA
tggctcggggtccaaacga

SEQ ID NO: 642 - DNA, 19 bp, synthetic construct
  source 1..19: mol_type = other DNA
  misc_feature 1..3: note = RNA
  misc_feature 4..6: note = DNA
  misc_feature 7..9: note = RNA
  misc_feature 10: note = DNA
  misc_feature 11..15: note = RNA
  misc_feature 16: note = DNA
  misc_feature 17..19: note = RNA
cgctttggctcggggtcca

SEQ ID NO: 643 - DNA, 19 bp, synthetic construct
  source 1..19: mol_type = other DNA
  misc_feature 1: note = DNA
  misc_feature 2..4: note = RNA
  misc_feature 5..7: note = DNA
  misc_feature 8..10: note = RNA
  misc_feature 11: note = DNA
  misc_feature 12..16: note = RNA
  misc_feature 17: note = DNA
  misc_feature 18..19: note = RNA
tcgctttggctcggggtcc

SEQ ID NO: 644 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6..8: note = DNA
  misc_feature 9..11: note = RNA
  misc_feature 12: note = DNA
  misc_feature 13..17: note = RNA
  misc_feature 18: note = DNA
  misc_feature 19: note = RNA
ctcgctttggctcggggtc

SEQ ID NO: 645 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7..9: note = DNA
  misc_feature 10..12: note = RNA
  misc_feature 13: note = DNA
  misc_feature 14..18: note = RNA
  misc_feature 19: note = DNA
cctcgctttggctcggggt

SEQ ID NO: 646 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8..10: note = DNA
  misc_feature 11..13: note = RNA
  misc_feature 14: note = DNA
  misc_feature 15..19: note = RNA
gcctcgctttggctcgggg

SEQ ID NO: 647 - DNA, 19 bp, synthetic construct
  source 1..19: mol_type = other DNA
  misc_feature 1..4: note = RNA
  misc_feature 5: note = DNA
  misc_feature 6..8: note = RNA
  misc_feature 9..11: note = DNA
  misc_feature 12..14: note = RNA
  misc_feature 15: note = DNA
  misc_feature 16..19: note = RNA
ggcctcgctttggctcggg

SEQ ID NO: 648 - DNA, 19 bp, synthetic construct
  source 1..19: mol_type = other DNA
  misc_feature 1..5: note = RNA
  misc_feature 6: note = DNA
  misc_feature 7..9: note = RNA
  misc_feature 10..12: note = DNA
  misc_feature 13..15: note = RNA
  misc_feature 16: note = DNA
  misc_feature 17..19: note = RNA
gggcctcgctttggctcgg

SEQ ID NO: 649 - DNA, 19 bp, synthetic construct
  source 1..19: mol_type = other DNA
  misc_feature 1..6: note = RNA
  misc_feature 7: note = DNA
  misc_feature 8..10: note = RNA
  misc_feature 11..13: note = DNA
  misc_feature 14..16: note = RNA
  misc_feature 17: note = DNA
  misc_feature 18..19: note = RNA
agggcctcgctttggctcg

SEQ ID NO: 650 - DNA, 19 bp, synthetic construct
  source 1..19: mol_type = other DNA
  misc_feature 1..7: note = RNA
  misc_feature 8: note = DNA
  misc_feature 9..11: note = RNA
  misc_feature 12..14: note = DNA
  misc_feature 15..17: note = RNA
  misc_feature 18: note = DNA
  misc_feature 19: note = RNA
cagggcctcgctttggctc

SEQ ID NO: 651 - DNA, 19 bp, synthetic construct
  source 1..19: mol_type = other DNA
  misc_feature 1..8: note = RNA
  misc_feature 9: note = DNA
  misc_feature 10..12: note = RNA
  misc_feature 13..15: note = DNA
  misc_feature 16..18: note = RNA
  misc_feature 19: note = DNA
gcagggcctcgctttggct

SEQ ID NO: 652 - DNA, 19 bp, synthetic construct
  source 1..19: mol_type = other DNA
  misc_feature 1..9: note = RNA
  misc_feature 10: note = DNA
  misc_feature 11..13: note = RNA
  misc_feature 14..16: note = DNA
  misc_feature 17..19: note = RNA
cgcagggcctcgctttggc

SEQ ID NO: 653 - DNA, 19 bp, synthetic construct
  source 1..19: mol_type = other DNA
  misc_feature 1: note = DNA
  misc_feature 2..10: note = RNA
  misc_feature 11: note = DNA
  misc_feature 12..14: note = RNA
  misc_feature 15..17: note = DNA
  misc_feature 18..19: note = RNA
tcgcagggcctcgctttgg

SEQ ID NO: 654 - DNA, 19 bp, synthetic construct
  source 1..19: mol_type = other DNA
  misc_feature 1: note = RNA
  misc_feature 2: note = DNA
  misc_feature 3..11: note = RNA
  misc_feature 12: note = DNA
  misc_feature 13..15: note = RNA
  misc_feature 16..18: note = DNA
  misc_feature 19: note = RNA
ctcgcagggcctcgctttg

SEQ ID NO: 655 - DNA, 19 bp, synthetic construct
  source 1..19: mol_type = other DNA
  misc_feature 1..2: note = RNA
  misc_feature 3: note = DNA
  misc_feature 4..12: note = RNA
  misc_feature 13: note = DNA
  misc_feature 14..16: note = RNA
  misc_feature 17..19: note = DNA
gctcgcagggcctcgcttt

SEQ ID NO: 656 - DNA, 19 bp, synthetic construct
  source 1..19: mol_type = other DNA
  misc_feature 1..3: note = RNA
  misc_feature 4: note = DNA
  misc_feature 5..13: note = RNA
  misc_feature 14: note = DNA
  misc_feature 15..17: note = RNA
  misc_feature 18..19: note = DNA
ggctcgcagggcctcgctt

SEQ ID NO: 657 - DNA, 19 bp, synthetic construct
  source 1..19: mol_type = other DNA
  misc_feature 1..4: note = RNA
  misc_feature 5..6: note = DNA
  misc_feature 7..10: note = RNA
  misc_feature 11: note = DNA
  misc_feature 12..19: note = RNA
cgggttccgctcaaagcag

SEQ ID NO: 658 - DNA, 19 bp, synthetic construct
  source 1..19: mol_type = other DNA
  misc_feature 1..5: note = RNA
  misc_feature 6..7: note = DNA
  misc_feature 8..11: note = RNA
  misc_feature 12: note = DNA
  misc_feature 13..19: note = RNA
acgggttccgctcaaagca

SEQ ID NO: 659 - DNA, 19 bp, synthetic construct
  source 1..19: mol_type = other DNA
  misc_feature 1: note = DNA
  misc_feature 2..6: note = RNA
  misc_feature 7..8: note = DNA
  misc_feature 9..12: note = RNA
  misc_feature 13: note = DNA
  misc_feature 14..19: note = RNA
tacgggttccgctcaaagc

SEQ ID NO: 660 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8..9: note = DNA
  misc_feature 10..13: note = RNA
  misc_feature 14: note = DNA
  misc_feature 15..19: note = RNA
gtacgggttccgctcaaag

SEQ ID NO: 661 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9..10: note = DNA
  misc_feature 11..14: note = RNA
  misc_feature 15: note = DNA
  misc_feature 16..19: note = RNA
ggtacgggttccgctcaaa

SEQ ID NO: 662 - DNA, 19 bp, synthetic construct
  source 1..19: mol_type = other DNA
  misc_feature 1..3: note = RNA
  misc_feature 4: note = DNA
  misc_feature 5..9: note = RNA
  misc_feature 10..11: note = DNA
  misc_feature 12..15: note = RNA
  misc_feature 16: note = DNA
  misc_feature 17..19: note = RNA
gggtacgggttccgctcaa

SEQ ID NO: 663 - DNA, 19 bp, synthetic construct
  source 1..19: mol_type = other DNA
  misc_feature 1..4: note = RNA
  misc_feature 5: note = DNA
  misc_feature 6..10: note = RNA
  misc_feature 11..12: note = DNA
  misc_feature 13..16: note = RNA
  misc_feature 17: note = DNA
  misc_feature 18..19: note = RNA
cgggtacgggttccgctca

SEQ ID NO: 664 - DNA, 19 bp, synthetic construct
  source 1..19: mol_type = other DNA
  misc_feature 1..5: note = RNA
  misc_feature 6: note = DNA
  misc_feature 7..11: note = RNA
  misc_feature 12..13: note = DNA
  misc_feature 14..17: note = RNA
  misc_feature 18: note = DNA
  misc_feature 19: note = RNA
ccgggtacgggttccgctc

SEQ ID NO: 665 - DNA, 19 bp, synthetic construct
  source 1..19: mol_type = other DNA
  misc_feature 1..6: note = RNA
  misc_feature 7: note = DNA
  misc_feature 8..12: note = RNA
  misc_feature 13..14: note = DNA
  misc_feature 15..18: note = RNA
  misc_feature 19: note = DNA
cccgggtacgggttccgct

SEQ ID NO: 666 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..14: note = RNA
  misc_feature 15: note = DNA
  misc_feature 16..19: note = RNA
tggcgatgcccgggtacgg

SEQ ID NO: 667 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8: note = DNA
  misc_feature 9..15: note = RNA
  misc_feature 16: note = DNA
  misc_feature 17..19: note = RNA
gtggcgatgcccgggtacg

SEQ ID NO: 668 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9: note = DNA
  misc_feature 10..16: note = RNA
  misc_feature 17: note = DNA
  misc_feature 18..19: note = RNA
ggtggcgatgcccgggtac

SEQ ID NO: 669 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..9: note = RNA
  misc_feature 10: note = DNA
  misc_feature 11..17: note = RNA
  misc_feature 18: note = DNA
  misc_feature 19: note = RNA
tggtggcgatgcccgggta

SEQ ID NO: 670 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..5: note = RNA
  misc_feature 6: note = DNA
  misc_feature 7..11: note = RNA
  misc_feature 12: note = DNA
  misc_feature 13..19: note = RNA
tctggtggcgatgcccggg

SEQ ID NO: 671 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..6: note = RNA
  misc_feature 7: note = DNA
  misc_feature 8..12: note = RNA
  misc_feature 13: note = DNA
  misc_feature 14..19: note = RNA
ctctggtggcgatgcccgg

SEQ ID NO: 672 - DNA, 19 bp, synthetic construct
  source 1..19: mol_type = other DNA
  misc_feature 1: note = DNA
  misc_feature 2: note = RNA
  misc_feature 3: note = DNA
  misc_feature 4: note = RNA
  misc_feature 5: note = DNA
  misc_feature 6..7: note = RNA
  misc_feature 8: note = DNA
  misc_feature 9..13: note = RNA
  misc_feature 14: note = DNA
  misc_feature 15..19: note = RNA
tctctggtggcgatgcccg

SEQ ID NO: 673 - DNA, 19 bp, synthetic construct
  source 1..19: mol_type = other DNA
  misc_feature 1..2: note = DNA
  misc_feature 3: note = RNA
  misc_feature 4: note = DNA
  misc_feature 5: note = RNA
  misc_feature 6: note = DNA
  misc_feature 7..8: note = RNA
  misc_feature 9: note = DNA
  misc_feature 10..14: note = RNA
  misc_feature 15: note = DNA
  misc_feature 16..19: note = RNA
ttctctggtggcgatgccc

SEQ ID NO: 674 - DNA, 19 bp, synthetic construct
  source 1..19: mol_type = other DNA
  misc_feature 1: note = RNA
  misc_feature 2..3: note = DNA
  misc_feature 4: note = RNA
  misc_feature 5: note = DNA
  misc_feature 6: note = RNA
  misc_feature 7: note = DNA
  misc_feature 8..9: note = RNA
  misc_feature 10: note = DNA
  misc_feature 11..15: note = RNA
  misc_feature 16: note = DNA
  misc_feature 17..19: note = RNA
gttctctggtggcgatgcc

SEQ ID NO: 675 - DNA, 19 bp, synthetic construct
  source 1..19: mol_type = other DNA
  misc_feature 1..2: note = RNA
  misc_feature 3..4: note = DNA
  misc_feature 5: note = RNA
  misc_feature 6: note = DNA
  misc_feature 7: note = RNA
  misc_feature 8: note = DNA
  misc_feature 9..10: note = RNA
  misc_feature 11: note = DNA
  misc_feature 12..16: note = RNA
  misc_feature 17: note = DNA
  misc_feature 18..19: note = RNA
cgttctctggtggcgatgc

SEQ ID NO: 676 - DNA, 19 bp, synthetic construct
  source 1..19: mol_type = other DNA
  misc_feature 1..3: note = RNA
  misc_feature 4..5: note = DNA
  misc_feature 6: note = RNA
  misc_feature 7: note = DNA
  misc_feature 8: note = RNA
  misc_feature 9: note = DNA
  misc_feature 10..11: note = RNA
  misc_feature 12: note = DNA
  misc_feature 13..17: note = RNA
  misc_feature 18: note = DNA
  misc_feature 19: note = RNA
ccgttctctggtggcgatg

SEQ ID NO: 677 - DNA, 19 bp, synthetic construct
  source 1..19: mol_type = other DNA
  misc_feature 1..4: note = RNA
  misc_feature 5..6: note = DNA
  misc_feature 7: note = RNA
  misc_feature 8: note = DNA
  misc_feature 9: note = RNA
  misc_feature 10: note = DNA
  misc_feature 11..12: note = RNA
  misc_feature 13: note = DNA
  misc_feature 14..18: note = RNA
  misc_feature 19: note = DNA
gccgttctctggtggcgat

SEQ ID NO: 678 - DNA, 19 bp, synthetic construct
  source 1..19: mol_type = other DNA
  misc_feature 1..5: note = RNA
  misc_feature 6..7: note = DNA
  misc_feature 8: note = RNA
  misc_feature 9: note = DNA
  misc_feature 10: note = RNA
  misc_feature 11: note = DNA
  misc_feature 12..13: note = RNA
  misc_feature 14: note = DNA
  misc_feature 15..19: note = RNA
agccgttctctggtggcga

SEQ ID NO: 679 - DNA, 19 bp, synthetic construct
  source 1..19: mol_type = other DNA
  misc_feature 1..6: note = RNA
  misc_feature 7..8: note = DNA
  misc_feature 9: note = RNA
  misc_feature 10: note = DNA
  misc_feature 11: note = RNA
  misc_feature 12: note = DNA
  misc_feature 13..14: note = RNA
  misc_feature 15: note = DNA
  misc_feature 16..19: note = RNA
cagccgttctctggtggcg

SEQ ID NO: 680 - DNA, 19 bp, synthetic construct
  source 1..19: mol_type = other DNA
  misc_feature 1: note = RNA
  misc_feature 2: note = DNA
  misc_feature 3..12: note = RNA
  misc_feature 13..14: note = DNA
  misc_feature 15: note = RNA
  misc_feature 16: note = DNA
  misc_feature 17: note = RNA
  misc_feature 18: note = DNA
  misc_feature 19: note = RNA
ctgggccagccgttctctg

SEQ ID NO: 681 - DNA, 19 bp, synthetic construct
  source 1..19: mol_type = other DNA
  misc_feature 1..2: note = RNA
  misc_feature 3: note = DNA
  misc_feature 4..13: note = RNA
  misc_feature 14..15: note = DNA
  misc_feature 16: note = RNA
  misc_feature 17: note = DNA
  misc_feature 18: note = RNA
  misc_feature 19: note = DNA
cctgggccagccgttctct

SEQ ID NO: 682 - DNA, 19 bp, synthetic construct
  source 1..19: mol_type = other DNA
  misc_feature 1..3: note = RNA
  misc_feature 4: note = DNA
  misc_feature 5..14: note = RNA
  misc_feature 15..16: note = DNA
  misc_feature 17: note = RNA
  misc_feature 18: note = DNA
  misc_feature 19: note = RNA
gcctgggccagccgttctc

SEQ ID NO: 683 - DNA, 19 bp, synthetic construct
  source 1..19: mol_type = other DNA
  misc_feature 1..4: note = RNA
  misc_feature 5: note = DNA
  misc_feature 6..15: note = RNA
  misc_feature 16..17: note = DNA
  misc_feature 18: note = RNA
  misc_feature 19: note = DNA
ggcctgggccagccgttct

SEQ ID NO: 684 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..16: note = RNA
  misc_feature 17..18: note = DNA
  misc_feature 19: note = RNA
tggcctgggccagccgttc

SEQ ID NO: 685 - DNA, 19 bp, synthetic construct
  source 1..19: mol_type = other DNA
  misc_feature 1..3: note = RNA
  misc_feature 4: note = DNA
  misc_feature 5..9: note = RNA
  misc_feature 10: note = DNA
  misc_feature 11..14: note = RNA
  misc_feature 15: note = DNA
  misc_feature 16..19: note = RNA
gaatgccgatggcctgggc

SEQ ID NO: 686 - DNA, 19 bp, synthetic construct
  source 1..19: mol_type = other DNA
  misc_feature 1..4: note = RNA
  misc_feature 5: note = DNA
  misc_feature 6..10: note = RNA
  misc_feature 11: note = DNA
  misc_feature 12..15: note = RNA
  misc_feature 16: note = DNA
  misc_feature 17..19: note = RNA
ggaatgccgatggcctggg

SEQ ID NO: 687 - DNA, 19 bp, synthetic construct
  source 1..19: mol_type = other DNA
  misc_feature 1..5: note = RNA
  misc_feature 6: note = DNA
  misc_feature 7..11: note = RNA
  misc_feature 12: note = DNA
  misc_feature 13..16: note = RNA
  misc_feature 17: note = DNA
  misc_feature 18..19: note = RNA
cggaatgccgatggcctgg

SEQ ID NO: 688 - DNA, 19 bp, synthetic construct
  source 1..19: mol_type = other DNA
  misc_feature 1..6: note = RNA
  misc_feature 7: note = DNA
  misc_feature 8..12: note = RNA
  misc_feature 13: note = DNA
  misc_feature 14..17: note = RNA
  misc_feature 18: note = DNA
  misc_feature 19: note = RNA
ccggaatgccgatggcctg

SEQ ID NO: 689 - DNA, 19 bp, synthetic construct
  source 1..19: mol_type = other DNA
  misc_feature 1: note = DNA
  misc_feature 2..7: note = RNA
  misc_feature 8: note = DNA
  misc_feature 9..13: note = RNA
  misc_feature 14: note = DNA
  misc_feature 15..18: note = RNA
  misc_feature 19: note = DNA
tccggaatgccgatggcct

SEQ ID NO: 690 - DNA, 19 bp, synthetic construct
  source 1..19: mol_type = other DNA
  misc_feature 1: note = RNA
  misc_feature 2: note = DNA
  misc_feature 3..8: note = RNA
  misc_feature 9: note = DNA
  misc_feature 10..14: note = RNA
  misc_feature 15: note = DNA
  misc_feature 16..19: note = RNA
ctccggaatgccgatggcc

SEQ ID NO: 691 - DNA, 19 bp, synthetic construct
  source 1..19: mol_type = other DNA
  misc_feature 1..2: note = RNA
  misc_feature 3: note = DNA
  misc_feature 4..9: note = RNA
  misc_feature 10: note = DNA
  misc_feature 11..15: note = RNA
  misc_feature 16: note = DNA
  misc_feature 17..19: note = RNA
gctccggaatgccgatggc

SEQ ID NO: 692 - DNA, 19 bp, synthetic construct
  source 1..19: mol_type = other DNA
  misc_feature 1..3: note = RNA
  misc_feature 4: note = DNA
  misc_feature 5..10: note = RNA
  misc_feature 11: note = DNA
  misc_feature 12..16: note = RNA
  misc_feature 17: note = DNA
  misc_feature 18..19: note = RNA
ggctccggaatgccgatgg

SEQ ID NO: 693 - DNA, 19 bp, synthetic construct
  source 1..19: mol_type = other DNA
  misc_feature 1..4: note = RNA
  misc_feature 5: note = DNA
  misc_feature 6..11: note = RNA
  misc_feature 12: note = DNA
  misc_feature 13..17: note = RNA
  misc_feature 18: note = DNA
  misc_feature 19: note = RNA
gggctccggaatgccgatg

SEQ ID NO: 694 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..12: note = RNA
  misc_feature 13: note = DNA
  misc_feature 14..18: note = RNA
  misc_feature 19: note = DNA
tgggctccggaatgccgat

SEQ ID NO: 695 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..13: note = RNA
  misc_feature 14: note = DNA
  misc_feature 15..19: note = RNA
ctgggctccggaatgccga

SEQ ID NO: 696 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9..14: note = RNA
  misc_feature 15: note = DNA
  misc_feature 16..19: note = RNA
cctgggctccggaatgccg

SEQ ID NO: 697 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10..15: note = RNA
  misc_feature 16: note = DNA
  misc_feature 17..19: note = RNA
ccctgggctccggaatgcc

SEQ ID NO: 698 - DNA, 19 bp, synthetic construct
  source 1..19: mol_type = other DNA
  misc_feature 1..4: note = RNA
  misc_feature 5: note = DNA
  misc_feature 6..9: note = RNA
  misc_feature 10: note = DNA
  misc_feature 11..16: note = RNA
  misc_feature 17: note = DNA
  misc_feature 18..19: note = RNA
accctgggctccggaatgc

SEQ ID NO: 699 - DNA, 19 bp, synthetic construct
  source 1..19: mol_type = other DNA
  misc_feature 1..5: note = RNA
  misc_feature 6: note = DNA
  misc_feature 7..10: note = RNA
  misc_feature 11: note = DNA
  misc_feature 12..17: note = RNA
  misc_feature 18: note = DNA
  misc_feature 19: note = RNA
gaccctgggctccggaatg

SEQ ID NO: 700 - DNA, 19 bp, synthetic construct
  source 1..19: mol_type = other DNA
  misc_feature 1..6: note = RNA
  misc_feature 7: note = DNA
  misc_feature 8..11: note = RNA
  misc_feature 12: note = DNA
  misc_feature 13..18: note = RNA
  misc_feature 19: note = DNA
ggaccctgggctccggaat

SEQ ID NO: 701 - DNA, 19 bp, synthetic construct
  source 1..19: mol_type = other DNA
  misc_feature 1: note = DNA
  misc_feature 2..7: note = RNA
  misc_feature 8: note = DNA
  misc_feature 9..12: note = RNA
  misc_feature 13: note = DNA
  misc_feature 14..19: note = RNA
tggaccctgggctccggaa

SEQ ID NO: 702 - DNA, 19 bp, synthetic construct
  source 1..19: mol_type = other DNA
  misc_feature 1: note = RNA
  misc_feature 2: note = DNA
  misc_feature 3..8: note = RNA
  misc_feature 9: note = DNA
  misc_feature 10..13: note = RNA
  misc_feature 14: note = DNA
  misc_feature 15..19: note = RNA
ctggaccctgggctccgga

SEQ ID NO: 703 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..9: note = RNA
  misc_feature 10: note = DNA
  misc_feature 11..14: note = RNA
  misc_feature 15: note = DNA
  misc_feature 16..19: note = RNA
tctggaccctgggctccgg

SEQ ID NO: 704 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..10: note = RNA
  misc_feature 11: note = DNA
  misc_feature 12..15: note = RNA
  misc_feature 16: note = DNA
  misc_feature 17..19: note = RNA
atctggaccctgggctccg

SEQ ID NO: 705 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..11: note = RNA
  misc_feature 12: note = DNA
  misc_feature 13..16: note = RNA
  misc_feature 17: note = DNA
  misc_feature 18..19: note = RNA
aatctggaccctgggctcc

SEQ ID NO: 706 - DNA, 19 bp, synthetic construct
  source 1..19: mol_type = other DNA
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..19: note = RNA
ctgaaaccaaatctggacc

SEQ ID NO: 707 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..12: note = RNA
  misc_feature 13: note = DNA
  misc_feature 14: note = RNA
  misc_feature 15: note = DNA
  misc_feature 16..19: note = RNA
tctgaaaccaaatctggac

SEQ ID NO: 708 - DNA, 19 bp, synthetic construct
  source 1..19: mol_type = other DNA
  misc_feature 1..2: note = DNA
  misc_feature 3: note = RNA
  misc_feature 4: note = DNA
  misc_feature 5..13: note = RNA
  misc_feature 14: note = DNA
  misc_feature 15: note = RNA
  misc_feature 16: note = DNA
  misc_feature 17..19: note = RNA
ttctgaaaccaaatctgga

SEQ ID NO: 709 - DNA, 19 bp, synthetic construct
  source 1..19: mol_type = other DNA
  misc_feature 1: note = RNA
  misc_feature 2..3: note = DNA
  misc_feature 4: note = RNA
  misc_feature 5: note = DNA
  misc_feature 6..14: note = RNA
  misc_feature 15: note = DNA
  misc_feature 16: note = RNA
  misc_feature 17: note = DNA
  misc_feature 18..19: note = RNA
attctgaaaccaaatctgg

SEQ ID NO: 710 - DNA, 19 bp, synthetic construct
  source 1..19: mol_type = other DNA
  misc_feature 1..2: note = RNA
  misc_feature 3..4: note = DNA
  misc_feature 5: note = RNA
  misc_feature 6: note = DNA
  misc_feature 7..15: note = RNA
  misc_feature 16: note = DNA
  misc_feature 17: note = RNA
  misc_feature 18: note = DNA
  misc_feature 19: note = RNA
cattctgaaaccaaatctg

SEQ ID NO: 711 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5..6: note = DNA
  misc_feature 7: note = RNA
  misc_feature 8: note = DNA
  misc_feature 9..17: note = RNA
  misc_feature 18: note = DNA
  misc_feature 19: note = RNA
ctcattctgaaaccaaatc

SEQ ID NO: 712 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..6: note = RNA
  misc_feature 7..8: note = DNA
  misc_feature 9: note = RNA
  misc_feature 10: note = DNA
  misc_feature 11..19: note = RNA
ctctcattctgaaaccaaa

SEQ ID NO: 713 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..7: note = RNA
  misc_feature 8..9: note = DNA
  misc_feature 10: note = RNA
  misc_feature 11: note = DNA
  misc_feature 12..19: note = RNA
cctctcattctgaaaccaa

SEQ ID NO: 714 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..8: note = RNA
  misc_feature 9..10: note = DNA
  misc_feature 11: note = RNA
  misc_feature 12: note = DNA
  misc_feature 13..19: note = RNA
acctctcattctgaaacca

SEQ ID NO: 715 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..9: note = RNA
  misc_feature 10..11: note = DNA
  misc_feature 12: note = RNA
  misc_feature 13: note = DNA
  misc_feature 14..19: note = RNA
gacctctcattctgaaacc

SEQ ID NO: 716 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7: note = RNA
  misc_feature 8: note = DNA
  misc_feature 9..10: note = RNA
  misc_feature 11..12: note = DNA
  misc_feature 13: note = RNA
  misc_feature 14: note = DNA
  misc_feature 15..19: note = RNA
tgacctctcattctgaaac

SEQ ID NO: 717 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8: note = RNA
  misc_feature 9: note = DNA
  misc_feature 10..11: note = RNA
  misc_feature 12..13: note = DNA
  misc_feature 14: note = RNA
  misc_feature 15: note = DNA
  misc_feature 16..19: note = RNA
gtgacctctcattctgaaa

SEQ ID NO: 718 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9: note = RNA
  misc_feature 10: note = DNA
  misc_feature 11..12: note = RNA
  misc_feature 13..14: note = DNA
  misc_feature 15: note = RNA
  misc_feature 16: note = DNA
  misc_feature 17..19: note = RNA
cgtgacctctcattctgaa

SEQ ID NO: 719 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10: note = RNA
  misc_feature 11: note = DNA
  misc_feature 12..13: note = RNA
  misc_feature 14..15: note = DNA
  misc_feature 16: note = RNA
  misc_feature 17: note = DNA
  misc_feature 18..19: note = RNA
gcgtgacctctcattctga

SEQ ID NO: 720 - DNA, 19 bp, synthetic construct
  source 1..19: mol_type = other DNA
  misc_feature 1..4: note = RNA
  misc_feature 5: note = DNA
  misc_feature 6..9: note = RNA
  misc_feature 10: note = DNA
  misc_feature 11: note = RNA
  misc_feature 12: note = DNA
  misc_feature 13..14: note = RNA
  misc_feature 15..16: note = DNA
  misc_feature 17: note = RNA
  misc_feature 18: note = DNA
  misc_feature 19: note = RNA
ggcgtgacctctcattctg

SEQ ID NO: 721 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..10: note = RNA
  misc_feature 11: note = DNA
  misc_feature 12: note = RNA
  misc_feature 13: note = DNA
  misc_feature 14..15: note = RNA
  misc_feature 16..17: note = DNA
  misc_feature 18: note = RNA
  misc_feature 19: note = DNA
tggcgtgacctctcattct

SEQ ID NO: 722 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..16: note = RNA
  misc_feature 17..18: note = DNA
  misc_feature 19: note = RNA
ctggcgtgacctctcattc

SEQ ID NO: 723 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9..12: note = RNA
  misc_feature 13: note = DNA
  misc_feature 14: note = RNA
  misc_feature 15: note = DNA
  misc_feature 16..17: note = RNA
  misc_feature 18..19: note = DNA
gctggcgtgacctctcatt

SEQ ID NO: 724 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10..13: note = RNA
  misc_feature 14: note = DNA
  misc_feature 15: note = RNA
  misc_feature 16: note = DNA
  misc_feature 17..18: note = RNA
  misc_feature 19: note = DNA
agctggcgtgacctctcat

SEQ ID NO: 725 - DNA, 19 bp, synthetic construct
  source 1..19: mol_type = other DNA
  misc_feature 1..4: note = RNA
  misc_feature 5: note = DNA
  misc_feature 6..9: note = RNA
  misc_feature 10: note = DNA
  misc_feature 11..14: note = RNA
  misc_feature 15: note = DNA
  misc_feature 16: note = RNA
  misc_feature 17: note = DNA
  misc_feature 18..19: note = RNA
cagctggcgtgacctctca

SEQ ID NO: 726 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..10: note = RNA
  misc_feature 11: note = DNA
  misc_feature 12..15: note = RNA
  misc_feature 16: note = DNA
  misc_feature 17: note = RNA
  misc_feature 18: note = DNA
  misc_feature 19: note = RNA
tcagctggcgtgacctctc

SEQ ID NO: 727 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13..16: note = RNA
  misc_feature 17: note = DNA
  misc_feature 18: note = RNA
  misc_feature 19: note = DNA
ctcagctggcgtgacctct

SEQ ID NO: 728 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9..12: note = RNA
  misc_feature 13: note = DNA
  misc_feature 14..17: note = RNA
  misc_feature 18: note = DNA
  misc_feature 19: note = RNA
cctcagctggcgtgacctc

SEQ ID NO: 729 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10..13: note = RNA
  misc_feature 14: note = DNA
  misc_feature 15..18: note = RNA
  misc_feature 19: note = DNA
gcctcagctggcgtgacct

SEQ ID NO: 730 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..9: note = RNA
  misc_feature 10: note = DNA
  misc_feature 11..14: note = RNA
  misc_feature 15: note = DNA
  misc_feature 16..19: note = RNA
tgcctcagctggcgtgacc

SEQ ID NO: 731 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..10: note = RNA
  misc_feature 11: note = DNA
  misc_feature 12..15: note = RNA
  misc_feature 16: note = DNA
  misc_feature 17..19: note = RNA
ctgcctcagctggcgtgac

SEQ ID NO: 732 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..11: note = RNA
  misc_feature 12: note = DNA
  misc_feature 13..16: note = RNA
  misc_feature 17: note = DNA
  misc_feature 18..19: note = RNA
gctgcctcagctggcgtga

SEQ ID NO: 733 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..7: note = RNA
  misc_feature 8: note = DNA
  misc_feature 9..12: note = RNA
  misc_feature 13: note = DNA
  misc_feature 14..17: note = RNA
  misc_feature 18: note = DNA
  misc_feature 19: note = RNA
tgctgcctcagctggcgtg

SEQ ID NO: 734 - DNA, 19 bp, synthetic construct
  source 1..19: mol_type = other DNA
  misc_feature 1: note = DNA
  misc_feature 2..9: note = RNA
  misc_feature 10: note = DNA
  misc_feature 11..12: note = RNA
  misc_feature 13: note = DNA
  misc_feature 14..16: note = RNA
  misc_feature 17: note = DNA
  misc_feature 18..19: note = RNA
tcccgccggtgctgcctca

SEQ ID NO: 735 - DNA, 19 bp, synthetic construct
  source 1..19: mol_type = other DNA
  misc_feature 1..2: note = DNA
  misc_feature 3..10: note = RNA
  misc_feature 11: note = DNA
  misc_feature 12..13: note = RNA
  misc_feature 14: note = DNA
  misc_feature 15..17: note = RNA
  misc_feature 18: note = DNA
  misc_feature 19: note = RNA
ttcccgccggtgctgcctc

SEQ ID NO: 736 - DNA, 19 bp, synthetic construct
  source 1..19: mol_type = other DNA
  misc_feature 1: note = RNA
  misc_feature 2..3: note = DNA
  misc_feature 4..11: note = RNA
  misc_feature 12: note = DNA
  misc_feature 13..14: note = RNA
  misc_feature 15: note = DNA
  misc_feature 16..18: note = RNA
  misc_feature 19: note = DNA
attcccgccggtgctgcct

SEQ ID NO: 737 - DNA, 19 bp, synthetic construct
  source 1..19: mol_type = other DNA
  misc_feature 1..2: note = RNA
  misc_feature 3..4: note = DNA
  misc_feature 5..12: note = RNA
  misc_feature 13: note = DNA
  misc_feature 14..15: note = RNA
  misc_feature 16: note = DNA
  misc_feature 17..19: note = RNA
gattcccgccggtgctgcc

SEQ ID NO: 738 - DNA, 19 bp, synthetic construct
  source 1..19: mol_type = other DNA
  misc_feature 1..3: note = RNA
  misc_feature 4..5: note = DNA
  misc_feature 6..13: note = RNA
  misc_feature 14: note = DNA
  misc_feature 15..16: note = RNA
  misc_feature 17: note = DNA
  misc_feature 18..19: note = RNA
agattcccgccggtgctgc

SEQ ID NO: 739 - DNA, 19 bp, synthetic construct
  source 1..19: mol_type = other DNA
  misc_feature 1..4: note = RNA
  misc_feature 5..6: note = DNA
  misc_feature 7..14: note = RNA
  misc_feature 15: note = DNA
  misc_feature 16..17: note = RNA
  misc_feature 18: note = DNA
  misc_feature 19: note = RNA
gagattcccgccggtgctg

SEQ ID NO: 740 - DNA, 19 bp, synthetic construct
  source 1..19: mol_type = other DNA
  misc_feature 1..5: note = RNA
  misc_feature 6..7: note = DNA
  misc_feature 8..15: note = RNA
  misc_feature 16: note = DNA
  misc_feature 17..18: note = RNA
  misc_feature 19: note = DNA
cgagattcccgccggtgct

SEQ ID NO: 741 - DNA, 19 bp, synthetic construct
  source 1..19: mol_type = other DNA
  misc_feature 1..6: note = RNA
  misc_feature 7..8: note = DNA
  misc_feature 9..16: note = RNA
  misc_feature 17: note = DNA
  misc_feature 18..19: note = RNA
ccgagattcccgccggtgc

SEQ ID NO: 742 - DNA, 19 bp, synthetic construct
  source 1..19: mol_type = other DNA
  misc_feature 1..7: note = RNA
  misc_feature 8..9: note = DNA
  misc_feature 10..17: note = RNA
  misc_feature 18: note = DNA
  misc_feature 19: note = RNA
gccgagattcccgccggtg

SEQ ID NO: 743 - DNA, 19 bp, synthetic construct
  source 1..19: mol_type = other DNA
  misc_feature 1..10: note = RNA
  misc_feature 11..12: note = DNA
  misc_feature 13..19: note = RNA
agggccgagattcccgccg

SEQ ID NO: 744 - DNA, 19 bp, synthetic construct
  source 1..19: mol_type = other DNA
  misc_feature 1..11: note = RNA
  misc_feature 12..13: note = DNA
  misc_feature 14..19: note = RNA
cagggccgagattcccgcc

SEQ ID NO: 745 - DNA, 19 bp, synthetic construct
  source 1..19: mol_type = other DNA
  misc_feature 1..12: note = RNA
  misc_feature 13..14: note = DNA
  misc_feature 15..19: note = RNA
ccagggccgagattcccgc

SEQ ID NO: 746 - DNA, 19 bp, synthetic construct
  source 1..19: mol_type = other DNA
  misc_feature 1..13: note = RNA
  misc_feature 14..15: note = DNA
  misc_feature 16..19: note = RNA
gccagggccgagattcccg

SEQ ID NO: 747 - DNA, 19 bp, synthetic construct
  source 1..19: mol_type = other DNA
  misc_feature 1..14: note = RNA
  misc_feature 15..16: note = DNA
  misc_feature 17..19: note = RNA
ggccagggccgagattccc

SEQ ID NO: 748 - DNA, 19 bp, synthetic construct
  source 1..19: mol_type = other DNA
  misc_feature 1..15: note = RNA
  misc_feature 16..17: note = DNA
  misc_feature 18..19: note = RNA
gggccagggccgagattcc

SEQ ID NO: 749 - DNA, 19 bp, synthetic construct
  source 1..19: mol_type = other DNA
  misc_feature 1..16: note = RNA
  misc_feature 17..18: note = DNA
  misc_feature 19: note = RNA
cgggccagggccgagattc

SEQ ID NO: 750 - DNA, 19 bp, synthetic construct
  source 1..19: mol_type = other DNA
  misc_feature 1..2: note = DNA
  misc_feature 3: note = RNA
  misc_feature 4: note = DNA
  misc_feature 5..15: note = RNA
  misc_feature 16: note = DNA
  misc_feature 17: note = RNA
  misc_feature 18: note = DNA
  misc_feature 19: note = RNA
ttctggcgggccgcgtctc

SEQ ID NO: 751 - DNA, 19 bp, synthetic construct
  source 1..19: mol_type = other DNA
  misc_feature 1: note = RNA
  misc_feature 2..3: note = DNA
  misc_feature 4: note = RNA
  misc_feature 5: note = DNA
  misc_feature 6..16: note = RNA
  misc_feature 17: note = DNA
  misc_feature 18: note = RNA
  misc_feature 19: note = DNA
cttctggcgggccgcgtct

SEQ ID NO: 752 - DNA, 19 bp, synthetic construct
  source 1..19: mol_type = other DNA
  misc_feature 1: note = RNA
  misc_feature 2..4: note = DNA
  misc_feature 5..12: note = RNA
  misc_feature 13..14: note = DNA
  misc_feature 15: note = RNA
  misc_feature 16: note = DNA
  misc_feature 17..19: note = RNA
ctttcgccggccttctggc

SEQ ID NO: 753 - DNA, 19 bp, synthetic construct
  source 1..19: mol_type = other DNA
  misc_feature 1..2: note = RNA
  misc_feature 3..5: note = DNA
  misc_feature 6..13: note = RNA
  misc_feature 14..15: note = DNA
  misc_feature 16: note = RNA
  misc_feature 17: note = DNA
  misc_feature 18..19: note = RNA
gctttcgccggccttctgg

SEQ ID NO: 754 - DNA, 19 bp, synthetic construct
  source 1..19: mol_type = other DNA
  misc_feature 1..3: note = RNA
  misc_feature 4..6: note = DNA
  misc_feature 7..14: note = RNA
  misc_feature 15..16: note = DNA
  misc_feature 17: note = RNA
  misc_feature 18: note = DNA
  misc_feature 19: note = RNA
cgctttcgccggccttctg

SEQ ID NO: 755 - DNA, 19 bp, synthetic construct
  source 1..19: mol_type = other DNA
  misc_feature 1..4: note = RNA
  misc_feature 5..7: note = DNA
  misc_feature 8..15: note = RNA
  misc_feature 16..17: note = DNA
  misc_feature 18: note = RNA
  misc_feature 19: note = DNA
ccgctttcgccggccttct

SEQ ID NO: 756 - DNA, 19 bp, synthetic construct
  source 1..19: mol_type = other DNA
  misc_feature 1: note = DNA
  misc_feature 2..5: note = RNA
  misc_feature 6..8: note = DNA
  misc_feature 9..16: note = RNA
  misc_feature 17..18: note = DNA
  misc_feature 19: note = RNA
tccgctttcgccggccttc

SEQ ID NO: 757 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7..9: note = DNA
  misc_feature 10..17: note = RNA
  misc_feature 18..19: note = DNA
gtccgctttcgccggcctt

SEQ ID NO: 758 - DNA, 19 bp, synthetic construct
  source 1..19: mol_type = other DNA
  misc_feature 1..8: note = RNA
  misc_feature 9: note = DNA
  misc_feature 10..13: note = RNA
  misc_feature 14..16: note = DNA
  misc_feature 17..19: note = RNA
gacggcggtccgctttcgc

SEQ ID NO: 759 - DNA, 19 bp, synthetic construct
  source 1..19: mol_type = other DNA
  misc_feature 1: note = DNA
  misc_feature 2..9: note = RNA
  misc_feature 10: note = DNA
  misc_feature 11..14: note = RNA
  misc_feature 15..17: note = DNA
  misc_feature 18..19: note = RNA
tgacggcggtccgctttcg

SEQ ID NO: 760 - DNA, 19 bp, synthetic construct
  source 1..19: mol_type = other DNA
  misc_feature 1: note = RNA
  misc_feature 2: note = DNA
  misc_feature 3..10: note = RNA
  misc_feature 11: note = DNA
  misc_feature 12..15: note = RNA
  misc_feature 16..18: note = DNA
  misc_feature 19: note = RNA
gtgacggcggtccgctttc

SEQ ID NO: 761 - DNA, 19 bp, synthetic construct
  source 1..19: mol_type = other DNA
  misc_feature 1..2: note = RNA
  misc_feature 3: note = DNA
  misc_feature 4..11: note = RNA
  misc_feature 12: note = DNA
  misc_feature 13..16: note = RNA
  misc_feature 17..19: note = DNA
ggtgacggcggtccgcttt

SEQ ID NO: 762 - DNA, 19 bp, synthetic construct
  source 1..19: mol_type = other DNA
  misc_feature 1..3: note = RNA
  misc_feature 4: note = DNA
  misc_feature 5..12: note = RNA
  misc_feature 13: note = DNA
  misc_feature 14..17: note = RNA
  misc_feature 18..19: note = DNA
cggtgacggcggtccgctt

SEQ ID NO: 763 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..15: note = RNA
  misc_feature 16: note = DNA
  misc_feature 17..19: note = RNA
atccggtgacggcggtccg

SEQ ID NO: 764 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9..16: note = RNA
  misc_feature 17: note = DNA
  misc_feature 18..19: note = RNA
gatccggtgacggcggtcc

SEQ ID NO: 765 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10..17: note = RNA
  misc_feature 18: note = DNA
  misc_feature 19: note = RNA
ggatccggtgacggcggtc

SEQ ID NO: 766 - DNA, 19 bp, synthetic construct
  source 1..19: mol_type = other DNA
  misc_feature 1..4: note = RNA
  misc_feature 5: note = DNA
  misc_feature 6..9: note = RNA
  misc_feature 10: note = DNA
  misc_feature 11..18: note = RNA
  misc_feature 19: note = DNA
gggatccggtgacggcggt

SEQ ID NO: 767 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..10: note = RNA
  misc_feature 11: note = DNA
  misc_feature 12..19: note = RNA
tgggatccggtgacggcgg

SEQ ID NO: 768 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..11: note = RNA
  misc_feature 12: note = DNA
  misc_feature 13..19: note = RNA
ctgggatccggtgacggcg

SEQ ID NO: 769 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..7: note = RNA
  misc_feature 8: note = DNA
  misc_feature 9..12: note = RNA
  misc_feature 13: note = DNA
  misc_feature 14..19: note = RNA
tctgggatccggtgacggc

SEQ ID NO: 770 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..8: note = RNA
  misc_feature 9: note = DNA
  misc_feature 10..13: note = RNA
  misc_feature 14: note = DNA
  misc_feature 15..19: note = RNA
gtctgggatccggtgacgg

SEQ ID NO: 771 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..9: note = RNA
  misc_feature 10: note = DNA
  misc_feature 11..14: note = RNA
  misc_feature 15: note = DNA
  misc_feature 16..19: note = RNA
ggtctgggatccggtgacg

SEQ ID NO: 772 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..10: note = RNA
  misc_feature 11: note = DNA
  misc_feature 12..15: note = RNA
  misc_feature 16: note = DNA
  misc_feature 17..19: note = RNA
cggtctgggatccggtgac

SEQ ID NO: 773 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..16: note = RNA
  misc_feature 17: note = DNA
  misc_feature 18..19: note = RNA
gcggtctgggatccggtga

SEQ ID NO: 774 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..12: note = RNA
  misc_feature 13: note = DNA
  misc_feature 14..17: note = RNA
  misc_feature 18: note = DNA
  misc_feature 19: note = RNA
ggcggtctgggatccggtg

SEQ ID NO: 775 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..13: note = RNA
  misc_feature 14: note = DNA
  misc_feature 15..18: note = RNA
  misc_feature 19: note = DNA
gggcggtctgggatccggt

SEQ ID NO: 776 - DNA, 19 bp, synthetic construct
  source 1..19: mol_type = other DNA
  misc_feature 1..7: note = RNA
  misc_feature 8: note = DNA
  misc_feature 9: note = RNA
  misc_feature 10: note = DNA
  misc_feature 11..14: note = RNA
  misc_feature 15: note = DNA
  misc_feature 16..19: note = RNA
agggcggtctgggatccgg

SEQ ID NO: 777 - DNA, 19 bp, synthetic construct
  source 1..19: mol_type = other DNA
  misc_feature 1..8: note = RNA
  misc_feature 9: note = DNA
  misc_feature 10: note = RNA
  misc_feature 11: note = DNA
  misc_feature 12..15: note = RNA
  misc_feature 16: note = DNA
  misc_feature 17..19: note = RNA
cagggcggtctgggatccg

SEQ ID NO: 778 - DNA, 19 bp, synthetic construct
  source 1..19: mol_type = other DNA
  misc_feature 1..9: note = RNA
  misc_feature 10: note = DNA
  misc_feature 11: note = RNA
  misc_feature 12: note = DNA
  misc_feature 13..16: note = RNA
  misc_feature 17: note = DNA
  misc_feature 18..19: note = RNA
gcagggcggtctgggatcc

SEQ ID NO: 779 - DNA, 19 bp, synthetic construct
  source 1..19: mol_type = other DNA
  misc_feature 1..10: note = RNA
  misc_feature 11: note = DNA
  misc_feature 12: note = RNA
  misc_feature 13: note = DNA
  misc_feature 14..17: note = RNA
  misc_feature 18: note = DNA
  misc_feature 19: note = RNA
agcagggcggtctgggatc

SEQ ID NO: 780 - DNA, 19 bp, synthetic construct
  source 1..19: mol_type = other DNA
  misc_feature 1..11: note = RNA
  misc_feature 12: note = DNA
  misc_feature 13: note = RNA
  misc_feature 14: note = DNA
  misc_feature 15..18: note = RNA
  misc_feature 19: note = DNA
gagcagggcggtctgggat

SEQ ID NO: 781 - DNA, 19 bp, synthetic construct
  source 1..19: mol_type = other DNA
  misc_feature 1..12: note = RNA
  misc_feature 13: note = DNA
  misc_feature 14: note = RNA
  misc_feature 15: note = DNA
  misc_feature 16..19: note = RNA
ggagcagggcggtctggga

SEQ ID NO: 782 - DNA, 19 bp, synthetic construct
  source 1..19: mol_type = other DNA
  misc_feature 1..13: note = RNA
  misc_feature 14: note = DNA
  misc_feature 15: note = RNA
  misc_feature 16: note = DNA
  misc_feature 17..19: note = RNA
aggagcagggcggtctggg

SEQ ID NO: 783 - DNA, 19 bp, synthetic construct
  source 1..19: mol_type = other DNA
  misc_feature 1..14: note = RNA
  misc_feature 15: note = DNA
  misc_feature 16: note = RNA
  misc_feature 17: note = DNA
  misc_feature 18..19: note = RNA
gaggagcagggcggtctgg

SEQ ID NO: 784 - DNA, 19 bp, synthetic construct
  source 1..19: mol_type = other DNA
  misc_feature 1..15: note = RNA
  misc_feature 16: note = DNA
  misc_feature 17: note = RNA
  misc_feature 18: note = DNA
  misc_feature 19: note = RNA
ggaggagcagggcggtctg

SEQ ID NO: 785 - DNA, 19 bp, synthetic construct
  source 1..19: mol_type = other DNA
  misc_feature 1..16: note = RNA
  misc_feature 17: note = DNA
  misc_feature 18: note = RNA
  misc_feature 19: note = DNA
cggaggagcagggcggtct

SEQ ID NO: 786 - DNA, 19 bp, synthetic construct
  source 1..19: mol_type = other DNA
  misc_feature 1: note = DNA
  misc_feature 2..17: note = RNA
  misc_feature 18: note = DNA
  misc_feature 19: note = RNA
tcggaggagcagggcggtc

SEQ ID NO: 787 - DNA, 19 bp, synthetic construct
  source 1..19: mol_type = other DNA
  misc_feature 1: note = RNA
  misc_feature 2: note = DNA
  misc_feature 3..18: note = RNA
  misc_feature 19: note = DNA
ctcggaggagcagggcggt

SEQ ID NO: 788 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..10: note = RNA
  misc_feature 11: note = DNA
  misc_feature 12..19: note = RNA
tctcaaaggctcggaggag

SEQ ID NO: 789 - DNA, 19 bp, synthetic construct
  source 1..19: mol_type = other DNA
  misc_feature 1..2: note = RNA
  misc_feature 3..4: note = DNA
  misc_feature 5: note = RNA
  misc_feature 6: note = DNA
  misc_feature 7..13: note = RNA
  misc_feature 14: note = DNA
  misc_feature 15..19: note = RNA
ccttctcaaaggctcggag

SEQ ID NO: 790 - DNA, 19 bp, synthetic construct
  source 1..19: mol_type = other DNA
  misc_feature 1..7: note = RNA
  misc_feature 8: note = DNA
  misc_feature 9..10: note = RNA
  misc_feature 11..12: note = DNA
  misc_feature 13: note = RNA
  misc_feature 14: note = DNA
  misc_feature 15..19: note = RNA
aaagcgatccttctcaaag

SEQ ID NO: 791 - DNA, 19 bp, synthetic construct
  source 1..19: mol_type = other DNA
  misc_feature 1..8: note = RNA
  misc_feature 9: note = DNA
  misc_feature 10..11: note = RNA
  misc_feature 12..13: note = DNA
  misc_feature 14: note = RNA
  misc_feature 15: note = DNA
  misc_feature 16..19: note = RNA
gaaagcgatccttctcaaa

SEQ ID NO: 792 - DNA, 19 bp, synthetic construct
  source 1..19: mol_type = other DNA
  misc_feature 1..9: note = RNA
  misc_feature 10: note = DNA
  misc_feature 11..12: note = RNA
  misc_feature 13..14: note = DNA
  misc_feature 15: note = RNA
  misc_feature 16: note = DNA
  misc_feature 17..19: note = RNA
ggaaagcgatccttctcaa

SEQ ID NO: 793 - DNA, 19 bp, synthetic construct
  source 1..19: mol_type = other DNA
  misc_feature 1: note = DNA
  misc_feature 2..10: note = RNA
  misc_feature 11: note = DNA
  misc_feature 12..13: note = RNA
  misc_feature 14..15: note = DNA
  misc_feature 16: note = RNA
  misc_feature 17: note = DNA
  misc_feature 18..19: note = RNA
tggaaagcgatccttctca

SEQ ID NO: 794 - DNA, 19 bp, synthetic construct
  source 1..19: mol_type = other DNA
  misc_feature 1: note = RNA
  misc_feature 2: note = DNA
  misc_feature 3..11: note = RNA
  misc_feature 12: note = DNA
  misc_feature 13..14: note = RNA
  misc_feature 15..16: note = DNA
  misc_feature 17: note = RNA
  misc_feature 18: note = DNA
  misc_feature 19: note = RNA
ctggaaagcgatccttctc

SEQ ID NO: 795 - DNA, 19 bp, synthetic construct
  source 1..19: mol_type = other DNA
  misc_feature 1..2: note = RNA
  misc_feature 3: note = DNA
  misc_feature 4..12: note = RNA
  misc_feature 13: note = DNA
  misc_feature 14..15: note = RNA
  misc_feature 16..17: note = DNA
  misc_feature 18: note = RNA
  misc_feature 19: note = DNA
cctggaaagcgatccttct

SEQ ID NO: 796 - DNA, 19 bp, synthetic construct
  source 1..19: mol_type = other DNA
  misc_feature 1..3: note = RNA
  misc_feature 4: note = DNA
  misc_feature 5..13: note = RNA
  misc_feature 14: note = DNA
  misc_feature 15..16: note = RNA
  misc_feature 17..18: note = DNA
  misc_feature 19: note = RNA
gcctggaaagcgatccttc

SEQ ID NO: 797 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..14: note = RNA
  misc_feature 15: note = DNA
  misc_feature 16..17: note = RNA
  misc_feature 18..19: note = DNA
tgcctggaaagcgatcctt

SEQ ID NO: 798 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..15: note = RNA
  misc_feature 16: note = DNA
  misc_feature 17..18: note = RNA
  misc_feature 19: note = DNA
atgcctggaaagcgatcct

SEQ ID NO: 799 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..16: note = RNA
  misc_feature 17: note = DNA
  misc_feature 18..19: note = RNA
gatgcctggaaagcgatcc

SEQ ID NO: 800 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8: note = DNA
  misc_feature 9..17: note = RNA
  misc_feature 18: note = DNA
  misc_feature 19: note = RNA
cgatgcctggaaagcgatc

SEQ ID NO: 801 - DNA, 19 bp, synthetic construct
  source 1..19: mol_type = other DNA
  misc_feature 1..4: note = RNA
  misc_feature 5: note = DNA
  misc_feature 6..8: note = RNA
  misc_feature 9: note = DNA
  misc_feature 10..18: note = RNA
  misc_feature 19: note = DNA
gcgatgcctggaaagcgat

SEQ ID NO: 802 - DNA, 19 bp, synthetic construct
  source 1..19: mol_type = other DNA
  misc_feature 1..5: note = RNA
  misc_feature 6: note = DNA
  misc_feature 7..9: note = RNA
  misc_feature 10: note = DNA
  misc_feature 11..19: note = RNA
ggcgatgcctggaaagcga

SEQ ID NO: 803 - DNA, 19 bp, synthetic construct
  source 1..19: mol_type = other DNA
  misc_feature 1..6: note = RNA
  misc_feature 7: note = DNA
  misc_feature 8..10: note = RNA
  misc_feature 11: note = DNA
  misc_feature 12..19: note = RNA
cggcgatgcctggaaagcg

SEQ ID NO: 804 - DNA, 19 bp, synthetic construct
  source 1..19: mol_type = other DNA
  misc_feature 1..7: note = RNA
  misc_feature 8: note = DNA
  misc_feature 9..11: note = RNA
  misc_feature 12: note = DNA
  misc_feature 13..19: note = RNA
gcggcgatgcctggaaagc

SEQ ID NO: 805 - DNA, 19 bp, synthetic construct
  source 1..19: mol_type = other DNA
  misc_feature 1..8: note = RNA
  misc_feature 9: note = DNA
  misc_feature 10..12: note = RNA
  misc_feature 13: note = DNA
  misc_feature 14..19: note = RNA
ggcggcgatgcctggaaag

SEQ ID NO: 806 - DNA, 19 bp, synthetic construct
  source 1..19: mol_type = other DNA
  misc_feature 1..9: note = RNA
  misc_feature 10: note = DNA
  misc_feature 11..13: note = RNA
  misc_feature 14: note = DNA
  misc_feature 15..19: note = RNA
gggcggcgatgcctggaaa

SEQ ID NO: 807 - DNA, 19 bp, synthetic construct
  source 1..19: mol_type = other DNA
  misc_feature 1..10: note = RNA
  misc_feature 11: note = DNA
  misc_feature 12..14: note = RNA
  misc_feature 15: note = DNA
  misc_feature 16..19: note = RNA
cgggcggcgatgcctggaa

SEQ ID NO: 808 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..10: note = RNA
  misc_feature 11: note = DNA
  misc_feature 12..13: note = RNA
  misc_feature 14: note = DNA
  misc_feature 15..19: note = RNA
tctggccagctcctcccgg

SEQ ID NO: 809 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..11: note = RNA
  misc_feature 12: note = DNA
  misc_feature 13..14: note = RNA
  misc_feature 15: note = DNA
  misc_feature 16..19: note = RNA
ctctggccagctcctcccg

SEQ ID NO: 810 - DNA, 19 bp, synthetic construct
  source 1..19: mol_type = other DNA
  misc_feature 1: note = DNA
  misc_feature 2: note = RNA
  misc_feature 3: note = DNA
  misc_feature 4: note = RNA
  misc_feature 5: note = DNA
  misc_feature 6..12: note = RNA
  misc_feature 13: note = DNA
  misc_feature 14..15: note = RNA
  misc_feature 16: note = DNA
  misc_feature 17..19: note = RNA
tctctggccagctcctccc

SEQ ID NO: 811 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5: note = RNA
  misc_feature 6: note = DNA
  misc_feature 7..13: note = RNA
  misc_feature 14: note = DNA
  misc_feature 15..16: note = RNA
  misc_feature 17: note = DNA
  misc_feature 18..19: note = RNA
ctctctggccagctcctcc

SEQ ID NO: 812 - DNA, 19 bp, synthetic construct
  source 1..19: mol_type = other DNA
  misc_feature 1: note = DNA
  misc_feature 2: note = RNA
  misc_feature 3: note = DNA
  misc_feature 4: note = RNA
  misc_feature 5: note = DNA
  misc_feature 6: note = RNA
  misc_feature 7: note = DNA
  misc_feature 8..14: note = RNA
  misc_feature 15: note = DNA
  misc_feature 16..17: note = RNA
  misc_feature 18: note = DNA
  misc_feature 19: note = RNA
tctctctggccagctcctc

SEQ ID NO: 813 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5: note = RNA
  misc_feature 6: note = DNA
  misc_feature 7: note = RNA
  misc_feature 8: note = DNA
  misc_feature 9..15: note = RNA
  misc_feature 16: note = DNA
  misc_feature 17..18: note = RNA
  misc_feature 19: note = DNA
gtctctctggccagctcct

SEQ ID NO: 814 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6: note = RNA
  misc_feature 7: note = DNA
  misc_feature 8: note = RNA
  misc_feature 9: note = DNA
  misc_feature 10..16: note = RNA
  misc_feature 17: note = DNA
  misc_feature 18..19: note = RNA
cgtctctctggccagctcc

SEQ ID NO: 815 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7: note = RNA
  misc_feature 8: note = DNA
  misc_feature 9: note = RNA
  misc_feature 10: note = DNA
  misc_feature 11..17: note = RNA
  misc_feature 18: note = DNA
  misc_feature 19: note = RNA
ccgtctctctggccagctc

SEQ ID NO: 816 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8: note = RNA
  misc_feature 9: note = DNA
  misc_feature 10: note = RNA
  misc_feature 11: note = DNA
  misc_feature 12..18: note = RNA
  misc_feature 19: note = DNA
cccgtctctctggccagct

SEQ ID NO: 817 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9: note = RNA
  misc_feature 10: note = DNA
  misc_feature 11: note = RNA
  misc_feature 12: note = DNA
  misc_feature 13..19: note = RNA
gcccgtctctctggccagc

SEQ ID NO: 818 - DNA, 19 bp, synthetic construct
  source 1..19: mol_type = other DNA
  misc_feature 1..9: note = RNA
  misc_feature 10: note = DNA
  misc_feature 11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..19: note = RNA
ggaggcccgtctctctggc

SEQ ID NO: 819 - DNA, 19 bp, synthetic construct
  source 1..19: mol_type = other DNA
  misc_feature 1..10: note = RNA
  misc_feature 11: note = DNA
  misc_feature 12: note = RNA
  misc_feature 13: note = DNA
  misc_feature 14: note = RNA
  misc_feature 15: note = DNA
  misc_feature 16: note = RNA
  misc_feature 17: note = DNA
  misc_feature 18..19: note = RNA
gggaggcccgtctctctgg

SEQ ID NO: 820 - DNA, 19 bp, synthetic construct
  source 1..19: mol_type = other DNA
  misc_feature 1..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17: note = RNA
  misc_feature 18: note = DNA
  misc_feature 19: note = RNA
cgggaggcccgtctctctg

SEQ ID NO: 821 - DNA, 19 bp, synthetic construct
  source 1..19: mol_type = other DNA
  misc_feature 1..12: note = RNA
  misc_feature 13: note = DNA
  misc_feature 14: note = RNA
  misc_feature 15: note = DNA
  misc_feature 16: note = RNA
  misc_feature 17: note = DNA
  misc_feature 18: note = RNA
  misc_feature 19: note = DNA
ccgggaggcccgtctctct

SEQ ID NO: 822 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..8: note = RNA
  misc_feature 9: note = DNA
  misc_feature 10..19: note = RNA
tcctggactccgggaggcc

SEQ ID NO: 823 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..9: note = RNA
  misc_feature 10: note = DNA
  misc_feature 11..19: note = RNA
atcctggactccgggaggc

SEQ ID NO: 824 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..10: note = RNA
  misc_feature 11: note = DNA
  misc_feature 12..19: note = RNA
aatcctggactccgggagg

SEQ ID NO: 825 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..11: note = RNA
  misc_feature 12: note = DNA
  misc_feature 13..19: note = RNA
gaatcctggactccgggag

SEQ ID NO: 826 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..7: note = RNA
  misc_feature 8: note = DNA
  misc_feature 9..12: note = RNA
  misc_feature 13: note = DNA
  misc_feature 14..19: note = RNA
tgaatcctggactccggga

SEQ ID NO: 827 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..8: note = RNA
  misc_feature 9: note = DNA
  misc_feature 10..13: note = RNA
  misc_feature 14: note = DNA
  misc_feature 15..19: note = RNA
ctgaatcctggactccggg

SEQ ID NO: 828 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..6: note = RNA
  misc_feature 7: note = DNA
  misc_feature 8..9: note = RNA
  misc_feature 10: note = DNA
  misc_feature 11..14: note = RNA
  misc_feature 15: note = DNA
  misc_feature 16..19: note = RNA
tctgaatcctggactccgg

SEQ ID NO: 829 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..7: note = RNA
  misc_feature 8: note = DNA
  misc_feature 9..10: note = RNA
  misc_feature 11: note = DNA
  misc_feature 12..15: note = RNA
  misc_feature 16: note = DNA
  misc_feature 17..19: note = RNA
atctgaatcctggactccg

SEQ ID NO: 830 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..8: note = RNA
  misc_feature 9: note = DNA
  misc_feature 10..11: note = RNA
  misc_feature 12: note = DNA
  misc_feature 13..16: note = RNA
  misc_feature 17: note = DNA
  misc_feature 18..19: note = RNA
gatctgaatcctggactcc

SEQ ID NO: 831 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..9: note = RNA
  misc_feature 10: note = DNA
  misc_feature 11..12: note = RNA
  misc_feature 13: note = DNA
  misc_feature 14..17: note = RNA
  misc_feature 18: note = DNA
  misc_feature 19: note = RNA
agatctgaatcctggactc

SEQ ID NO: 832 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..10: note = RNA
  misc_feature 11: note = DNA
  misc_feature 12..13: note = RNA
  misc_feature 14: note = DNA
  misc_feature 15..18: note = RNA
  misc_feature 19: note = DNA
cagatctgaatcctggact

SEQ ID NO: 833 - DNA, 19 bp, synthetic construct
  source 1..19: mol_type = other DNA
  misc_feature 1..8: note = RNA
  misc_feature 9: note = DNA
  misc_feature 10: note = RNA
  misc_feature 11: note = DNA
  misc_feature 12..14: note = RNA
  misc_feature 15: note = DNA
  misc_feature 16..17: note = RNA
  misc_feature 18: note = DNA
  misc_feature 19: note = RNA
aaaccagatctgaatcctg

SEQ ID NO: 834 - DNA, 19 bp, synthetic construct
  source 1..19: mol_type = other DNA
  misc_feature 1..9: note = RNA
  misc_feature 10: note = DNA
  misc_feature 11: note = RNA
  misc_feature 12: note = DNA
  misc_feature 13..15: note = RNA
  misc_feature 16: note = DNA
  misc_feature 17..18: note = RNA
  misc_feature 19: note = DNA
gaaaccagatctgaatcct

SEQ ID NO: 835 - DNA, 19 bp, synthetic construct
  source 1..19: mol_type = other DNA
  misc_feature 1: note = DNA
  misc_feature 2..10: note = RNA
  misc_feature 11: note = DNA
  misc_feature 12: note = RNA
  misc_feature 13: note = DNA
  misc_feature 14..16: note = RNA
  misc_feature 17: note = DNA
  misc_feature 18..19: note = RNA
tgaaaccagatctgaatcc

SEQ ID NO: 836 - DNA, 19 bp, synthetic construct
  source 1..19: mol_type = other DNA
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15..17: note = RNA
  misc_feature 18: note = DNA
  misc_feature 19: note = RNA
ctgaaaccagatctgaatc

SEQ ID NO: 837 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..12: note = RNA
  misc_feature 13: note = DNA
  misc_feature 14: note = RNA
  misc_feature 15: note = DNA
  misc_feature 16..18: note = RNA
  misc_feature 19: note = DNA
tctgaaaccagatctgaat

SEQ ID NO: 838 - DNA, 19 bp, synthetic construct
  source 1..19: mol_type = other DNA
  misc_feature 1..2: note = RNA
  misc_feature 3..4: note = DNA
  misc_feature 5..7: note = RNA
  misc_feature 8..9: note = DNA
  misc_feature 10: note = RNA
  misc_feature 11: note = DNA
  misc_feature 12..19: note = RNA
ccttcgattctgaaaccag

SEQ ID NO: 839 - DNA, 19 bp, synthetic construct
  source 1..19: mol_type = other DNA
  misc_feature 1..3: note = RNA
  misc_feature 4..5: note = DNA
  misc_feature 6..8: note = RNA
  misc_feature 9..10: note = DNA
  misc_feature 11: note = RNA
  misc_feature 12: note = DNA
  misc_feature 13..19: note = RNA
cccttcgattctgaaacca

SEQ ID NO: 840 - DNA, 19 bp, synthetic construct
  source 1..19: mol_type = other DNA
  misc_feature 1..4: note = RNA
  misc_feature 5..6: note = DNA
  misc_feature 7..9: note = RNA
  misc_feature 10..11: note = DNA
  misc_feature 12: note = RNA
  misc_feature 13: note = DNA
  misc_feature 14..19: note = RNA
gcccttcgattctgaaacc

SEQ ID NO: 841 - DNA, 19 bp, synthetic construct
  source 1..19: mol_type = other DNA
  misc_feature 1..5: note = RNA
  misc_feature 6..7: note = DNA
  misc_feature 8..10: note = RNA
  misc_feature 11..12: note = DNA
  misc_feature 13: note = RNA
  misc_feature 14: note = DNA
  misc_feature 15..19: note = RNA
ggcccttcgattctgaaac

SEQ ID NO: 842 - DNA, 19 bp, synthetic construct
  source 1..19: mol_type = other DNA
  misc_feature 1: note = DNA
  misc_feature 2..6: note = RNA
  misc_feature 7..8: note = DNA
  misc_feature 9..11: note = RNA
  misc_feature 12..13: note = DNA
  misc_feature 14: note = RNA
  misc_feature 15: note = DNA
  misc_feature 16..19: note = RNA
tggcccttcgattctgaaa

SEQ ID NO: 843 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8..9: note = DNA
  misc_feature 10..12: note = RNA
  misc_feature 13..14: note = DNA
  misc_feature 15: note = RNA
  misc_feature 16: note = DNA
  misc_feature 17..19: note = RNA
ctggcccttcgattctgaa

SEQ ID NO: 844 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9..10: note = DNA
  misc_feature 11..13: note = RNA
  misc_feature 14..15: note = DNA
  misc_feature 16: note = RNA
  misc_feature 17: note = DNA
  misc_feature 18..19: note = RNA
cctggcccttcgattctga

SEQ ID NO: 845 - DNA, 19 bp, synthetic construct
  source 1..19: mol_type = other DNA
  misc_feature 1..3: note = RNA
  misc_feature 4: note = DNA
  misc_feature 5..9: note = RNA
  misc_feature 10..11: note = DNA
  misc_feature 12..14: note = RNA
  misc_feature 15..16: note = DNA
  misc_feature 17: note = RNA
  misc_feature 18: note = DNA
  misc_feature 19: note = RNA
gcctggcccttcgattctg

SEQ ID NO: 846 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..10: note = RNA
  misc_feature 11..12: note = DNA
  misc_feature 13..15: note = RNA
  misc_feature 16..17: note = DNA
  misc_feature 18: note = RNA
  misc_feature 19: note = DNA
tgcctggcccttcgattct

SEQ ID NO: 847 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..11: note = RNA
  misc_feature 12..13: note = DNA
  misc_feature 14..16: note = RNA
  misc_feature 17..18: note = DNA
  misc_feature 19: note = RNA
gtgcctggcccttcgattc

SEQ ID NO: 848 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..12: note = RNA
  misc_feature 13..14: note = DNA
  misc_feature 15..17: note = RNA
  misc_feature 18..19: note = DNA
ggtgcctggcccttcgatt

SEQ ID NO: 849 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8: note = DNA
  misc_feature 9..13: note = RNA
  misc_feature 14..15: note = DNA
  misc_feature 16..18: note = RNA
  misc_feature 19: note = DNA
gggtgcctggcccttcgat

SEQ ID NO: 850 - DNA, 19 bp, synthetic construct
  source 1..19: mol_type = other DNA
  misc_feature 1..4: note = RNA
  misc_feature 5: note = DNA
  misc_feature 6..8: note = RNA
  misc_feature 9: note = DNA
  misc_feature 10..14: note = RNA
  misc_feature 15..16: note = DNA
  misc_feature 17..19: note = RNA
cgggtgcctggcccttcga

SEQ ID NO: 851 - DNA, 19 bp, synthetic construct
  source 1..19: mol_type = other DNA
  misc_feature 1..12: note = RNA
  misc_feature 13: note = DNA
  misc_feature 14..19: note = RNA
gagggagcagggtgacccc

SEQ ID NO: 852 - DNA, 19 bp, synthetic construct
  source 1..19: mol_type = other DNA
  misc_feature 1..13: note = RNA
  misc_feature 14: note = DNA
  misc_feature 15..19: note = RNA
cgagggagcagggtgaccc

SEQ ID NO: 853 - DNA, 19 bp, synthetic construct
  source 1..19: mol_type = other DNA
  misc_feature 1..14: note = RNA
  misc_feature 15: note = DNA
  misc_feature 16..19: note = RNA
acgagggagcagggtgacc

SEQ ID NO: 854 - DNA, 19 bp, synthetic construct
  source 1..19: mol_type = other DNA
  misc_feature 1..15: note = RNA
  misc_feature 16: note = DNA
  misc_feature 17..19: note = RNA
cacgagggagcagggtgac

SEQ ID NO: 855 - DNA, 19 bp, synthetic construct
  source 1..19: mol_type = other DNA
  misc_feature 1..16: note = RNA
  misc_feature 17: note = DNA
  misc_feature 18..19: note = RNA
ccacgagggagcagggtga

SEQ ID NO: 856 - DNA, 19 bp, synthetic construct
  source 1..19: mol_type = other DNA
  misc_feature 1..17: note = RNA
  misc_feature 18: note = DNA
  misc_feature 19: note = RNA
cccacgagggagcagggtg

SEQ ID NO: 857 - RNA, 19 nt, synthetic construct
  source 1..19: mol_type = other RNA
gacccacgagggagcaggg

SEQ ID NO: 858 - RNA, 19 nt, synthetic construct
  source 1..19: mol_type = other RNA
cgacccacgagggagcagg

SEQ ID NO: 859 - RNA, 19 nt, synthetic construct
  source 1..19: mol_type = other RNA
gcgacccacgagggagcag

SEQ ID NO: 860 - RNA, 19 nt, synthetic construct
  source 1..19: mol_type = other RNA
ggcgacccacgagggagca

SEQ ID NO: 861 - RNA, 19 nt, synthetic construct
  source 1..19: mol_type = other RNA
aggcgacccacgagggagc

SEQ ID NO: 862 - RNA, 19 nt, synthetic construct
  source 1..19: mol_type = other RNA
aaggcgacccacgagggag

SEQ ID NO: 863 - RNA, 19 nt, synthetic construct
  source 1..19: mol_type = other RNA
gaaggcgacccacgaggga

SEQ ID NO: 864 - RNA, 19 nt, synthetic construct
  source 1..19: mol_type = other RNA
cgaaggcgacccacgaggg

SEQ ID NO: 865 - RNA, 19 nt, synthetic construct
  source 1..19: mol_type = other RNA
gcgaaggcgacccacgagg

SEQ ID NO: 866 - RNA, 19 nt, synthetic construct
  source 1..19: mol_type = other RNA
ggcgaaggcgacccacgag

SEQ ID NO: 867 - RNA, 19 nt, synthetic construct
  source 1..19: mol_type = other RNA
gggcgaaggcgacccacga

SEQ ID NO: 868 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..19: note = RNA
gtgtgggcgaaggcgaccc

SEQ ID NO: 869 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..19: note = RNA
ggtgtgggcgaaggcgacc

SEQ ID NO: 870 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..19: note = RNA
cggtgtgggcgaaggcgac

SEQ ID NO: 871 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..19: note = RNA
ccggtgtgggcgaaggcga

SEQ ID NO: 872 - DNA, 19 bp, synthetic construct
  source 1..19: mol_type = other DNA
  misc_feature 1..2: note = DNA
  misc_feature 3..15: note = RNA
  misc_feature 16: note = DNA
  misc_feature 17: note = RNA
  misc_feature 18: note = DNA
  misc_feature 19: note = RNA
ttccccacgcgccggtgtg

SEQ ID NO: 873 - DNA, 19 bp, synthetic construct
  source 1..19: mol_type = other DNA
  misc_feature 1: note = RNA
  misc_feature 2..3: note = DNA
  misc_feature 4..16: note = RNA
  misc_feature 17: note = DNA
  misc_feature 18: note = RNA
  misc_feature 19: note = DNA
gttccccacgcgccggtgt

SEQ ID NO: 874 - DNA, 19 bp, synthetic construct
  source 1..19: mol_type = other DNA
  misc_feature 1..8: note = RNA
  misc_feature 9..10: note = DNA
  misc_feature 11..19: note = RNA
aagccccgttccccacgcg

SEQ ID NO: 875 - DNA, 19 bp, synthetic construct
  source 1..19: mol_type = other DNA
  misc_feature 1..9: note = RNA
  misc_feature 10..11: note = DNA
  misc_feature 12..19: note = RNA
gaagccccgttccccacgc

SEQ ID NO: 876 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10..19: note = RNA
acgtggggtgcgggaagcc

SEQ ID NO: 877 - DNA, 19 bp, synthetic construct
  source 1..19: mol_type = other DNA
  misc_feature 1..4: note = RNA
  misc_feature 5: note = DNA
  misc_feature 6..9: note = RNA
  misc_feature 10: note = DNA
  misc_feature 11..19: note = RNA
cacgtggggtgcgggaagc

SEQ ID NO: 878 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..8: note = RNA
  misc_feature 9: note = DNA
  misc_feature 10..12: note = RNA
  misc_feature 13: note = DNA
  misc_feature 14..19: note = RNA
tcgctgcctggctcacgaa

SEQ ID NO: 879 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..9: note = RNA
  misc_feature 10: note = DNA
  misc_feature 11..13: note = RNA
  misc_feature 14: note = DNA
  misc_feature 15..19: note = RNA
ctcgctgcctggctcacga

SEQ ID NO: 880 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..10: note = RNA
  misc_feature 11: note = DNA
  misc_feature 12..14: note = RNA
  misc_feature 15: note = DNA
  misc_feature 16..19: note = RNA
cctcgctgcctggctcacg

SEQ ID NO: 881 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8: note = DNA
  misc_feature 9..11: note = RNA
  misc_feature 12: note = DNA
  misc_feature 13..15: note = RNA
  misc_feature 16: note = DNA
  misc_feature 17..19: note = RNA
ccctcgctgcctggctcac

SEQ ID NO: 882 - DNA, 19 bp, synthetic construct
  source 1..19: mol_type = other DNA
  misc_feature 1..4: note = RNA
  misc_feature 5: note = DNA
  misc_feature 6..9: note = RNA
  misc_feature 10: note = DNA
  misc_feature 11: note = RNA
  misc_feature 12: note = DNA
  misc_feature 13..19: note = RNA
gagatcccctctgccggcg

SEQ ID NO: 883 - DNA, 19 bp, synthetic construct
  source 1..19: mol_type = other DNA
  misc_feature 1..5: note = RNA
  misc_feature 6: note = DNA
  misc_feature 7..10: note = RNA
  misc_feature 11: note = DNA
  misc_feature 12: note = RNA
  misc_feature 13: note = DNA
  misc_feature 14..19: note = RNA
ggagatcccctctgccggc

SEQ ID NO: 884 - DNA, 19 bp, synthetic construct
  source 1..19: mol_type = other DNA
  misc_feature 1..6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15..19: note = RNA
gggagatcccctctgccgg

SEQ ID NO: 885 - DNA, 19 bp, synthetic construct
  source 1..19: mol_type = other DNA
  misc_feature 1: note = DNA
  misc_feature 2..7: note = RNA
  misc_feature 8: note = DNA
  misc_feature 9..12: note = RNA
  misc_feature 13: note = DNA
  misc_feature 14: note = RNA
  misc_feature 15: note = DNA
  misc_feature 16..19: note = RNA
tgggagatcccctctgccg

SEQ ID NO: 886 - DNA, 19 bp, synthetic construct
  source 1..19: mol_type = other DNA
  misc_feature 1..2: note = DNA
  misc_feature 3..8: note = RNA
  misc_feature 9: note = DNA
  misc_feature 10..13: note = RNA
  misc_feature 14: note = DNA
  misc_feature 15: note = RNA
  misc_feature 16: note = DNA
  misc_feature 17..19: note = RNA
ttgggagatcccctctgcc

SEQ ID NO: 887 - DNA, 19 bp, synthetic construct
  source 1..19: mol_type = other DNA
  misc_feature 1..8: note = RNA
  misc_feature 9..10: note = DNA
  misc_feature 11..16: note = RNA
  misc_feature 17: note = DNA
  misc_feature 18..19: note = RNA
ggggcaggttgggagatcc

SEQ ID NO: 888 - DNA, 19 bp, synthetic construct
  source 1..19: mol_type = other DNA
  misc_feature 1..9: note = RNA
  misc_feature 10..11: note = DNA
  misc_feature 12..17: note = RNA
  misc_feature 18: note = DNA
  misc_feature 19: note = RNA
cggggcaggttgggagatc

SEQ ID NO: 889 - DNA, 19 bp, synthetic construct
  source 1..19: mol_type = other DNA
  misc_feature 1..10: note = RNA
  misc_feature 11..12: note = DNA
  misc_feature 13..18: note = RNA
  misc_feature 19: note = DNA
ccggggcaggttgggagat

SEQ ID NO: 890 - DNA, 19 bp, synthetic construct
  source 1..19: mol_type = other DNA
  misc_feature 1..11: note = RNA
  misc_feature 12..13: note = DNA
  misc_feature 14..19: note = RNA
gccggggcaggttgggaga

SEQ ID NO: 891 - DNA, 19 bp, synthetic construct
  source 1..19: mol_type = other DNA
  misc_feature 1..2: note = RNA
  misc_feature 3: note = DNA
  misc_feature 4..11: note = RNA
  misc_feature 12: note = DNA
  misc_feature 13..19: note = RNA
cgtaggcgaaatccccgcg

SEQ ID NO: 892 - DNA, 19 bp, synthetic construct
  source 1..19: mol_type = other DNA
  misc_feature 1..3: note = RNA
  misc_feature 4: note = DNA
  misc_feature 5..12: note = RNA
  misc_feature 13: note = DNA
  misc_feature 14..19: note = RNA
gcgtaggcgaaatccccgc

SEQ ID NO: 893 - DNA, 19 bp, synthetic construct
  source 1..19: mol_type = other DNA
  misc_feature 1..4: note = RNA
  misc_feature 5: note = DNA
  misc_feature 6..13: note = RNA
  misc_feature 14: note = DNA
  misc_feature 15..19: note = RNA
ggcgtaggcgaaatccccg

SEQ ID NO: 894 - DNA, 19 bp, synthetic construct
  source 1..19: mol_type = other DNA
  misc_feature 1..5: note = RNA
  misc_feature 6: note = DNA
  misc_feature 7..14: note = RNA
  misc_feature 15: note = DNA
  misc_feature 16..19: note = RNA
cggcgtaggcgaaatcccc

SEQ ID NO: 895 - DNA, 19 bp, synthetic construct
  source 1..19: mol_type = other DNA
  misc_feature 1..6: note = RNA
  misc_feature 7: note = DNA
  misc_feature 8..15: note = RNA
  misc_feature 16: note = DNA
  misc_feature 17..19: note = RNA
gcggcgtaggcgaaatccc

SEQ ID NO: 896 - DNA, 19 bp, synthetic construct
  source 1..19: mol_type = other DNA
  misc_feature 1..7: note = RNA
  misc_feature 8: note = DNA
  misc_feature 9..16: note = RNA
  misc_feature 17: note = DNA
  misc_feature 18..19: note = RNA
ggcggcgtaggcgaaatcc

SEQ ID NO: 897 - DNA, 19 bp, synthetic construct
  source 1..19: mol_type = other DNA
  misc_feature 1..8: note = RNA
  misc_feature 9: note = DNA
  misc_feature 10..17: note = RNA
  misc_feature 18: note = DNA
  misc_feature 19: note = RNA
gggcggcgtaggcgaaatc

SEQ ID NO: 898 - DNA, 19 bp, synthetic construct
  source 1..19: mol_type = other DNA
  misc_feature 1..9: note = RNA
  misc_feature 10: note = DNA
  misc_feature 11..18: note = RNA
  misc_feature 19: note = DNA
ggggcggcgtaggcgaaat

SEQ ID NO: 899 - DNA, 19 bp, synthetic construct
  source 1..19: mol_type = other DNA
  misc_feature 1..10: note = RNA
  misc_feature 11: note = DNA
  misc_feature 12..19: note = RNA
cggggcggcgtaggcgaaa

SEQ ID NO: 900 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..19: note = RNA
tgagggtgggagagcgccc

SEQ ID NO: 901 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8: note = DNA
  misc_feature 9..19: note = RNA
ctgagggtgggagagcgcc

SEQ ID NO: 902 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9: note = DNA
  misc_feature 10..19: note = RNA
cctgagggtgggagagcgc

SEQ ID NO: 903 - DNA, 19 bp, synthetic construct
  source 1..19: mol_type = other DNA
  misc_feature 1..3: note = RNA
  misc_feature 4: note = DNA
  misc_feature 5..9: note = RNA
  misc_feature 10: note = DNA
  misc_feature 11..19: note = RNA
gcctgagggtgggagagcg

SEQ ID NO: 904 - DNA, 19 bp, synthetic construct
  source 1..19: mol_type = other DNA
  misc_feature 1..4: note = RNA
  misc_feature 5: note = DNA
  misc_feature 6..10: note = RNA
  misc_feature 11: note = DNA
  misc_feature 12..19: note = RNA
agcctgagggtgggagagc

SEQ ID NO: 905 - DNA, 19 bp, synthetic construct
  source 1..19: mol_type = other DNA
  misc_feature 1..5: note = RNA
  misc_feature 6: note = DNA
  misc_feature 7..11: note = RNA
  misc_feature 12: note = DNA
  misc_feature 13..19: note = RNA
gagcctgagggtgggagag

SEQ ID NO: 906 - DNA, 19 bp, synthetic construct
  source 1..19: mol_type = other DNA
  misc_feature 1..6: note = RNA
  misc_feature 7: note = DNA
  misc_feature 8..12: note = RNA
  misc_feature 13: note = DNA
  misc_feature 14..19: note = RNA
ggagcctgagggtgggaga

SEQ ID NO: 907 - DNA, 19 bp, synthetic construct
  source 1..19: mol_type = other DNA
  misc_feature 1..7: note = RNA
  misc_feature 8: note = DNA
  misc_feature 9..13: note = RNA
  misc_feature 14: note = DNA
  misc_feature 15..19: note = RNA
aggagcctgagggtgggag

SEQ ID NO: 908 - DNA, 19 bp, synthetic construct
  source 1..19: mol_type = other DNA
  misc_feature 1..8: note = RNA
  misc_feature 9: note = DNA
  misc_feature 10..14: note = RNA
  misc_feature 15: note = DNA
  misc_feature 16..19: note = RNA
gaggagcctgagggtggga

SEQ ID NO: 909 - DNA, 19 bp, synthetic construct
  source 1..19: mol_type = other DNA
  misc_feature 1..9: note = RNA
  misc_feature 10: note = DNA
  misc_feature 11..15: note = RNA
  misc_feature 16: note = DNA
  misc_feature 17..19: note = RNA
cgaggagcctgagggtggg

SEQ ID NO: 910 - DNA, 19 bp, synthetic construct
  source 1..19: mol_type = other DNA
  misc_feature 1..10: note = RNA
  misc_feature 11: note = DNA
  misc_feature 12..16: note = RNA
  misc_feature 17: note = DNA
  misc_feature 18..19: note = RNA
ccgaggagcctgagggtgg

SEQ ID NO: 911 - DNA, 19 bp, synthetic construct
  source 1..19: mol_type = other DNA
  misc_feature 1..11: note = RNA
  misc_feature 12: note = DNA
  misc_feature 13..17: note = RNA
  misc_feature 18: note = DNA
  misc_feature 19: note = RNA
accgaggagcctgagggtg

SEQ ID NO: 912 - DNA, 19 bp, synthetic construct
  source 1..19: mol_type = other DNA
  misc_feature 1..12: note = RNA
  misc_feature 13: note = DNA
  misc_feature 14..18: note = RNA
  misc_feature 19: note = DNA
caccgaggagcctgagggt

SEQ ID NO: 913 - DNA, 19 bp, synthetic construct
  source 1..19: mol_type = other DNA
  misc_feature 1..13: note = RNA
  misc_feature 14: note = DNA
  misc_feature 15..19: note = RNA
ccaccgaggagcctgaggg

SEQ ID NO: 914 - DNA, 19 bp, synthetic construct
  source 1..19: mol_type = other DNA
  misc_feature 1..14: note = RNA
  misc_feature 15: note = DNA
  misc_feature 16..19: note = RNA
gccaccgaggagcctgagg

SEQ ID NO: 915 - DNA, 19 bp, synthetic construct
  source 1..19: mol_type = other DNA
  misc_feature 1..15: note = RNA
  misc_feature 16: note = DNA
  misc_feature 17..19: note = RNA
ggccaccgaggagcctgag

SEQ ID NO: 916 - DNA, 19 bp, synthetic construct
  source 1..19: mol_type = other DNA
  misc_feature 1: note = DNA
  misc_feature 2..19: note = RNA
tgcggaggccaccgaggag

SEQ ID NO: 917 - DNA, 19 bp, synthetic construct
  source 1..19: mol_type = other DNA
  misc_feature 1: note = RNA
  misc_feature 2: note = DNA
  misc_feature 3..19: note = RNA
gtgcggaggccaccgagga

SEQ ID NO: 918 - DNA, 19 bp, synthetic construct
  source 1..19: mol_type = other DNA
  misc_feature 1..3: note = DNA
  misc_feature 4..10: note = RNA
  misc_feature 11: note = DNA
  misc_feature 12..19: note = RNA
tttgcccgggtgcggaggc

SEQ ID NO: 919 - DNA, 19 bp, synthetic construct
  source 1..19: mol_type = other DNA
  misc_feature 1..4: note = DNA
  misc_feature 5..11: note = RNA
  misc_feature 12: note = DNA
  misc_feature 13..19: note = RNA
ttttgcccgggtgcggagg

SEQ ID NO: 920 - DNA, 19 bp, synthetic construct
  source 1..19: mol_type = other DNA
  misc_feature 1: note = RNA
  misc_feature 2..5: note = DNA
  misc_feature 6..12: note = RNA
  misc_feature 13: note = DNA
  misc_feature 14..19: note = RNA
cttttgcccgggtgcggag

SEQ ID NO: 921 - DNA, 19 bp, synthetic construct
  source 1..19: mol_type = other DNA
  misc_feature 1..2: note = RNA
  misc_feature 3..6: note = DNA
  misc_feature 7..13: note = RNA
  misc_feature 14: note = DNA
  misc_feature 15..19: note = RNA
gcttttgcccgggtgcgga

SEQ ID NO: 922 - DNA, 19 bp, synthetic construct
  source 1..19: mol_type = other DNA
  misc_feature 1..3: note = RNA
  misc_feature 4..7: note = DNA
  misc_feature 8..14: note = RNA
  misc_feature 15: note = DNA
  misc_feature 16..19: note = RNA
ggcttttgcccgggtgcgg

SEQ ID NO: 923 - DNA, 19 bp, synthetic construct
  source 1..19: mol_type = other DNA
  misc_feature 1..4: note = RNA
  misc_feature 5..8: note = DNA
  misc_feature 9..15: note = RNA
  misc_feature 16: note = DNA
  misc_feature 17..19: note = RNA
cggcttttgcccgggtgcg

SEQ ID NO: 924 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..10: note = RNA
  misc_feature 11..14: note = DNA
  misc_feature 15..19: note = RNA
tcctcccggcttttgcccg

SEQ ID NO: 925 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..11: note = RNA
  misc_feature 12..15: note = DNA
  misc_feature 16..19: note = RNA
gtcctcccggcttttgccc

SEQ ID NO: 926 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..12: note = RNA
  misc_feature 13..16: note = DNA
  misc_feature 17..19: note = RNA
ggtcctcccggcttttgcc

SEQ ID NO: 927 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..13: note = RNA
  misc_feature 14..17: note = DNA
  misc_feature 18..19: note = RNA
cggtcctcccggcttttgc

SEQ ID NO: 928 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..19: note = RNA
aggctgtgccaccgcgcag

SEQ ID NO: 929 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..19: note = RNA
caggctgtgccaccgcgca

SEQ ID NO: 930 - DNA, 19 bp, synthetic construct
  source 1..19: mol_type = other DNA
  misc_feature 1: note = DNA
  misc_feature 2..15: note = RNA
  misc_feature 16: note = DNA
  misc_feature 17: note = RNA
  misc_feature 18: note = DNA
  misc_feature 19: note = RNA
tgagcgggcccaggctgtg

SEQ ID NO: 931 - DNA, 19 bp, synthetic construct
  source 1..19: mol_type = other DNA
  misc_feature 1..2: note = DNA
  misc_feature 3..16: note = RNA
  misc_feature 17: note = DNA
  misc_feature 18: note = RNA
  misc_feature 19: note = DNA
ttgagcgggcccaggctgt

SEQ ID NO: 932 - DNA, 19 bp, synthetic construct
  source 1..19: mol_type = other DNA
  misc_feature 1: note = RNA
  misc_feature 2..3: note = DNA
  misc_feature 4..17: note = RNA
  misc_feature 18: note = DNA
  misc_feature 19: note = RNA
cttgagcgggcccaggctg

SEQ ID NO: 933 - DNA, 19 bp, synthetic construct
  source 1..19: mol_type = other DNA
  misc_feature 1..2: note = RNA
  misc_feature 3..4: note = DNA
  misc_feature 5..18: note = RNA
  misc_feature 19: note = DNA
gcttgagcgggcccaggct

SEQ ID NO: 934 - DNA, 19 bp, synthetic construct
  source 1..19: mol_type = other DNA
  misc_feature 1..8: note = RNA
  misc_feature 9..10: note = DNA
  misc_feature 11..15: note = RNA
  misc_feature 16: note = DNA
  misc_feature 17..19: note = RNA
agcaccccttggccctgcg

SEQ ID NO: 935 - DNA, 19 bp, synthetic construct
  source 1..19: mol_type = other DNA
  misc_feature 1..9: note = RNA
  misc_feature 10..11: note = DNA
  misc_feature 12..16: note = RNA
  misc_feature 17: note = DNA
  misc_feature 18..19: note = RNA
aagcaccccttggccctgc

SEQ ID NO: 936 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..12: note = RNA
  misc_feature 13: note = DNA
  misc_feature 14..16: note = RNA
  misc_feature 17: note = DNA
  misc_feature 18..19: note = RNA
tcccctgggacgtgggtgg

SEQ ID NO: 937 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..13: note = RNA
  misc_feature 14: note = DNA
  misc_feature 15..17: note = RNA
  misc_feature 18: note = DNA
  misc_feature 19: note = RNA
ctcccctgggacgtgggtg

SEQ ID NO: 938 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9..14: note = RNA
  misc_feature 15: note = DNA
  misc_feature 16..18: note = RNA
  misc_feature 19: note = DNA
actcccctgggacgtgggt

SEQ ID NO: 939 - DNA, 19 bp, synthetic construct
  source 1..19: mol_type = other DNA
  misc_feature 1..10: note = RNA
  misc_feature 11: note = DNA
  misc_feature 12..15: note = RNA
  misc_feature 16: note = DNA
  misc_feature 17..19: note = RNA
caccacggactcccctggg

SEQ ID NO: 940 - DNA, 19 bp, synthetic construct
  source 1..19: mol_type = other DNA
  misc_feature 1..11: note = RNA
  misc_feature 12: note = DNA
  misc_feature 13..16: note = RNA
  misc_feature 17: note = DNA
  misc_feature 18..19: note = RNA
ccaccacggactcccctgg

SEQ ID NO: 941 - DNA, 19 bp, synthetic construct
  source 1..19: mol_type = other DNA
  misc_feature 1..12: note = RNA
  misc_feature 13: note = DNA
  misc_feature 14..17: note = RNA
  misc_feature 18: note = DNA
  misc_feature 19: note = RNA
cccaccacggactcccctg

SEQ ID NO: 942 - DNA, 19 bp, synthetic construct
  source 1..19: mol_type = other DNA
  misc_feature 1..13: note = RNA
  misc_feature 14: note = DNA
  misc_feature 15..18: note = RNA
  misc_feature 19: note = DNA
ccccaccacggactcccct

SEQ ID NO: 943 - DNA, 19 bp, synthetic construct
  source 1..19: mol_type = other DNA
  misc_feature 1..2: note = DNA
  misc_feature 3..6: note = RNA
  misc_feature 7..8: note = DNA
  misc_feature 9..19: note = RNA
ttggggttcccacgccgcc

SEQ ID NO: 944 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..15: note = RNA
  misc_feature 16..17: note = DNA
  misc_feature 18..19: note = RNA
tggagctgccccggcttgg

SEQ ID NO: 945 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8: note = DNA
  misc_feature 9..16: note = RNA
  misc_feature 17..18: note = DNA
  misc_feature 19: note = RNA
gtggagctgccccggcttg

SEQ ID NO: 946 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9: note = DNA
  misc_feature 10..17: note = RNA
  misc_feature 18..19: note = DNA
ggtggagctgccccggctt

SEQ ID NO: 947 - DNA, 19 bp, synthetic construct
  source 1..19: mol_type = other DNA
  misc_feature 1: note = DNA
  misc_feature 2..8: note = RNA
  misc_feature 9: note = DNA
  misc_feature 10..14: note = RNA
  misc_feature 15: note = DNA
  misc_feature 16..19: note = RNA
tggggaggtggagctgccc

SEQ ID NO: 948 - DNA, 19 bp, synthetic construct
  source 1..19: mol_type = other DNA
  misc_feature 1: note = RNA
  misc_feature 2: note = DNA
  misc_feature 3..9: note = RNA
  misc_feature 10: note = DNA
  misc_feature 11..15: note = RNA
  misc_feature 16: note = DNA
  misc_feature 17..19: note = RNA
ctggggaggtggagctgcc

SEQ ID NO: 949 - DNA, 19 bp, synthetic construct
  source 1..19: mol_type = other DNA
  misc_feature 1..2: note = RNA
  misc_feature 3: note = DNA
  misc_feature 4..10: note = RNA
  misc_feature 11: note = DNA
  misc_feature 12..16: note = RNA
  misc_feature 17: note = DNA
  misc_feature 18..19: note = RNA
gctggggaggtggagctgc

SEQ ID NO: 950 - DNA, 19 bp, synthetic construct
  source 1..19: mol_type = other DNA
  misc_feature 1..3: note = RNA
  misc_feature 4: note = DNA
  misc_feature 5..11: note = RNA
  misc_feature 12: note = DNA
  misc_feature 13..17: note = RNA
  misc_feature 18: note = DNA
  misc_feature 19: note = RNA
ggctggggaggtggagctg

SEQ ID NO: 951 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6: note = RNA
  misc_feature 7: note = DNA
  misc_feature 8..12: note = RNA
  misc_feature 13: note = DNA
  misc_feature 14..19: note = RNA
tgcatctgcccctgccgcg

SEQ ID NO: 952 - DNA, 19 bp, synthetic construct
  source 1..19: mol_type = other DNA
  misc_feature 1: note = RNA
  misc_feature 2..3: note = DNA
  misc_feature 4..6: note = RNA
  misc_feature 7: note = DNA
  misc_feature 8: note = RNA
  misc_feature 9: note = DNA
  misc_feature 10..14: note = RNA
  misc_feature 15: note = DNA
  misc_feature 16..19: note = RNA
cttgcatctgcccctgccg

SEQ ID NO: 953 - DNA, 19 bp, synthetic construct
  source 1..19: mol_type = other DNA
  misc_feature 1..2: note = RNA
  misc_feature 3..4: note = DNA
  misc_feature 5..7: note = RNA
  misc_feature 8: note = DNA
  misc_feature 9: note = RNA
  misc_feature 10: note = DNA
  misc_feature 11..15: note = RNA
  misc_feature 16: note = DNA
  misc_feature 17..19: note = RNA
ccttgcatctgcccctgcc

SEQ ID NO: 954 - DNA, 19 bp, synthetic construct
  source 1..19: mol_type = other DNA
  misc_feature 1..3: note = RNA
  misc_feature 4..5: note = DNA
  misc_feature 6..8: note = RNA
  misc_feature 9: note = DNA
  misc_feature 10: note = RNA
  misc_feature 11: note = DNA
  misc_feature 12..16: note = RNA
  misc_feature 17: note = DNA
  misc_feature 18..19: note = RNA
gccttgcatctgcccctgc

SEQ ID NO: 955 - DNA, 19 bp, synthetic construct
  source 1..19: mol_type = other DNA
  misc_feature 1: note = DNA
  misc_feature 2..4: note = RNA
  misc_feature 5..6: note = DNA
  misc_feature 7..9: note = RNA
  misc_feature 10: note = DNA
  misc_feature 11: note = RNA
  misc_feature 12: note = DNA
  misc_feature 13..17: note = RNA
  misc_feature 18: note = DNA
  misc_feature 19: note = RNA
tgccttgcatctgcccctg

SEQ ID NO: 956 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6..7: note = DNA
  misc_feature 8..10: note = RNA
  misc_feature 11: note = DNA
  misc_feature 12: note = RNA
  misc_feature 13: note = DNA
  misc_feature 14..18: note = RNA
  misc_feature 19: note = DNA
atgccttgcatctgcccct

SEQ ID NO: 957 - DNA, 19 bp, synthetic construct
  source 1..19: mol_type = other DNA
  misc_feature 1..10: note = RNA
  misc_feature 11: note = DNA
  misc_feature 12..14: note = RNA
  misc_feature 15..16: note = DNA
  misc_feature 17..19: note = RNA
ggcgccgggatgccttgca

SEQ ID NO: 958 - DNA, 19 bp, synthetic construct
  source 1..19: mol_type = other DNA
  misc_feature 1..12: note = RNA
  misc_feature 13: note = DNA
  misc_feature 14..16: note = RNA
  misc_feature 17..18: note = DNA
  misc_feature 19: note = RNA
agggcgccgggatgccttg

SEQ ID NO: 959 - DNA, 19 bp, synthetic construct
  source 1..19: mol_type = other DNA
  misc_feature 1..13: note = RNA
  misc_feature 14: note = DNA
  misc_feature 15..17: note = RNA
  misc_feature 18..19: note = DNA
gagggcgccgggatgcctt

SEQ ID NO: 960 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..12: note = RNA
  misc_feature 13: note = DNA
  misc_feature 14..19: note = RNA
tcctggagcgcctgggagg

SEQ ID NO: 961 - DNA, 19 bp, synthetic construct
  source 1..19: mol_type = other DNA
  misc_feature 1..3: note = RNA
  misc_feature 4: note = DNA
  misc_feature 5..19: note = RNA
gagtgcagaccagggcgcc

SEQ ID NO: 962 - DNA, 19 bp, synthetic construct
  source 1..19: mol_type = other DNA
  misc_feature 1..4: note = RNA
  misc_feature 5: note = DNA
  misc_feature 6..19: note = RNA
ggagtgcagaccagggcgc

SEQ ID NO: 963 - DNA, 19 bp, synthetic construct
  source 1..19: mol_type = other DNA
  misc_feature 1..5: note = RNA
  misc_feature 6: note = DNA
  misc_feature 7..19: note = RNA
gggagtgcagaccagggcg

SEQ ID NO: 964 - DNA, 19 bp, synthetic construct
  source 1..19: mol_type = other DNA
  misc_feature 1..6: note = RNA
  misc_feature 7: note = DNA
  misc_feature 8..19: note = RNA
ggggagtgcagaccagggc

SEQ ID NO: 965 - DNA, 19 bp, synthetic construct
  source 1..19: mol_type = other DNA
  misc_feature 1..7: note = RNA
  misc_feature 8: note = DNA
  misc_feature 9..19: note = RNA
aggggagtgcagaccaggg

SEQ ID NO: 966 - DNA, 19 bp, synthetic construct
  source 1..19: mol_type = other DNA
  misc_feature 1..8: note = RNA
  misc_feature 9: note = DNA
  misc_feature 10..19: note = RNA
caggggagtgcagaccagg

SEQ ID NO: 967 - DNA, 19 bp, synthetic construct
  source 1..19: mol_type = other DNA
  misc_feature 1..9: note = RNA
  misc_feature 10: note = DNA
  misc_feature 11..19: note = RNA
gcaggggagtgcagaccag

SEQ ID NO: 968 - DNA, 19 bp, synthetic construct
  source 1..19: mol_type = other DNA
  misc_feature 1..10: note = RNA
  misc_feature 11: note = DNA
  misc_feature 12..19: note = RNA
cgcaggggagtgcagacca

SEQ ID NO: 969 - DNA, 19 bp, synthetic construct
  source 1..19: mol_type = other DNA
  misc_feature 1..11: note = RNA
  misc_feature 12: note = DNA
  misc_feature 13..19: note = RNA
ccgcaggggagtgcagacc

SEQ ID NO: 970 - DNA, 19 bp, synthetic construct
  source 1..19: mol_type = other DNA
  misc_feature 1..12: note = RNA
  misc_feature 13: note = DNA
  misc_feature 14..19: note = RNA
gccgcaggggagtgcagac

SEQ ID NO: 971 - DNA, 19 bp, synthetic construct
  source 1..19: mol_type = other DNA
  misc_feature 1..13: note = RNA
  misc_feature 14: note = DNA
  misc_feature 15..19: note = RNA
ggccgcaggggagtgcaga

SEQ ID NO: 972 - DNA, 19 bp, synthetic construct
  source 1..19: mol_type = other DNA
  misc_feature 1..14: note = RNA
  misc_feature 15: note = DNA
  misc_feature 16..19: note = RNA
aggccgcaggggagtgcag

SEQ ID NO: 973 - DNA, 19 bp, synthetic construct
  source 1..19: mol_type = other DNA
  misc_feature 1..15: note = RNA
  misc_feature 16: note = DNA
  misc_feature 17..19: note = RNA
caggccgcaggggagtgca

SEQ ID NO: 974 - DNA, 19 bp, synthetic construct
  source 1..19: mol_type = other DNA
  misc_feature 1..17: note = RNA
  misc_feature 18: note = DNA
  misc_feature 19: note = RNA
agcaggccgcaggggagtg

SEQ ID NO: 975 - DNA, 19 bp, synthetic construct
  source 1..19: mol_type = other DNA
  misc_feature 1..18: note = RNA
  misc_feature 19: note = DNA
cagcaggccgcaggggagt

SEQ ID NO: 976 - RNA, 19 nt, synthetic construct
  source 1..19: mol_type = other RNA
agcagcaggccgcagggga

SEQ ID NO: 977 - DNA, 19 bp, synthetic construct
  source 1..19: mol_type = other DNA
  misc_feature 1: note = DNA
  misc_feature 2..19: note = RNA
tccagcagcaggccgcagg

SEQ ID NO: 978 - DNA, 19 bp, synthetic construct
  source 1..19: mol_type = other DNA
  misc_feature 1: note = RNA
  misc_feature 2: note = DNA
  misc_feature 3..19: note = RNA
atccagcagcaggccgcag

SEQ ID NO: 979 - DNA, 19 bp, synthetic construct
  source 1..19: mol_type = other DNA
  misc_feature 1..2: note = RNA
  misc_feature 3: note = DNA
  misc_feature 4..19: note = RNA
catccagcagcaggccgca

SEQ ID NO: 980 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..19: note = RNA
tcatccagcagcaggccgc

SEQ ID NO: 981 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..19: note = RNA
ctcatccagcagcaggccg

SEQ ID NO: 982 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..19: note = RNA
gctcatccagcagcaggcc

SEQ ID NO: 983 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..19: note = RNA
agctcatccagcagcaggc

SEQ ID NO: 984 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8: note = DNA
  misc_feature 9..19: note = RNA
gagctcatccagcagcagg

SEQ ID NO: 985 - DNA, 19 bp, synthetic construct
  source 1..19: mol_type = other DNA
  misc_feature 1..5: note = RNA
  misc_feature 6: note = DNA
  misc_feature 7..8: note = RNA
  misc_feature 9: note = DNA
  misc_feature 10..19: note = RNA
ggagctcatccagcagcag

SEQ ID NO: 986 - DNA, 19 bp, synthetic construct
  source 1..19: mol_type = other DNA
  misc_feature 1..6: note = RNA
  misc_feature 7: note = DNA
  misc_feature 8..9: note = RNA
  misc_feature 10: note = DNA
  misc_feature 11..19: note = RNA
aggagctcatccagcagca

SEQ ID NO: 987 - DNA, 19 bp, synthetic construct
  source 1..19: mol_type = other DNA
  misc_feature 1..7: note = RNA
  misc_feature 8: note = DNA
  misc_feature 9..10: note = RNA
  misc_feature 11: note = DNA
  misc_feature 12..19: note = RNA
caggagctcatccagcagc

SEQ ID NO: 988 - DNA, 19 bp, synthetic construct
  source 1..19: mol_type = other DNA
  misc_feature 1..8: note = RNA
  misc_feature 9: note = DNA
  misc_feature 10..11: note = RNA
  misc_feature 12: note = DNA
  misc_feature 13..19: note = RNA
ccaggagctcatccagcag

SEQ ID NO: 989 - DNA, 19 bp, synthetic construct
  source 1..19: mol_type = other DNA
  misc_feature 1..9: note = RNA
  misc_feature 10: note = DNA
  misc_feature 11..12: note = RNA
  misc_feature 13: note = DNA
  misc_feature 14..19: note = RNA
gccaggagctcatccagca

SEQ ID NO: 990 - DNA, 19 bp, synthetic construct
  source 1..19: mol_type = other DNA
  misc_feature 1..10: note = RNA
  misc_feature 11: note = DNA
  misc_feature 12..13: note = RNA
  misc_feature 14: note = DNA
  misc_feature 15..19: note = RNA
cgccaggagctcatccagc

SEQ ID NO: 991 - DNA, 19 bp, synthetic construct
  source 1..19: mol_type = other DNA
  misc_feature 1..3: note = RNA
  misc_feature 4: note = DNA
  misc_feature 5..10: note = RNA
  misc_feature 11: note = DNA
  misc_feature 12..19: note = RNA
aactccgggctcgccagga

SEQ ID NO: 992 - DNA, 19 bp, synthetic construct
  source 1..19: mol_type = other DNA
  misc_feature 1..4: note = RNA
  misc_feature 5: note = DNA
  misc_feature 6..11: note = RNA
  misc_feature 12: note = DNA
  misc_feature 13..19: note = RNA
aaactccgggctcgccagg

SEQ ID NO: 993 - DNA, 19 bp, synthetic construct
  source 1..19: mol_type = other DNA
  misc_feature 1..5: note = RNA
  misc_feature 6: note = DNA
  misc_feature 7..12: note = RNA
  misc_feature 13: note = DNA
  misc_feature 14..19: note = RNA
gaaactccgggctcgccag

SEQ ID NO: 994 - DNA, 19 bp, synthetic construct
  source 1..19: mol_type = other DNA
  misc_feature 1: note = RNA
  misc_feature 2: note = DNA
  misc_feature 3..10: note = RNA
  misc_feature 11: note = DNA
  misc_feature 12..17: note = RNA
  misc_feature 18: note = DNA
  misc_feature 19: note = RNA
ctgcagaaactccgggctc

SEQ ID NO: 995 - DNA, 19 bp, synthetic construct
  source 1..19: mol_type = other DNA
  misc_feature 1..2: note = RNA
  misc_feature 3: note = DNA
  misc_feature 4..11: note = RNA
  misc_feature 12: note = DNA
  misc_feature 13..18: note = RNA
  misc_feature 19: note = DNA
gctgcagaaactccgggct

SEQ ID NO: 996 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..12: note = RNA
  misc_feature 13: note = DNA
  misc_feature 14..19: note = RNA
tgctgcagaaactccgggc

SEQ ID NO: 997 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..13: note = RNA
  misc_feature 14: note = DNA
  misc_feature 15..19: note = RNA
ctgctgcagaaactccggg

SEQ ID NO: 998 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..14: note = RNA
  misc_feature 15: note = DNA
  misc_feature 16..19: note = RNA
cctgctgcagaaactccgg

SEQ ID NO: 999 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..15: note = RNA
  misc_feature 16: note = DNA
  misc_feature 17..19: note = RNA
gcctgctgcagaaactccg

SEQ ID NO: 1000 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8: note = DNA
  misc_feature 9..16: note = RNA
  misc_feature 17: note = DNA
  misc_feature 18..19: note = RNA
cgcctgctgcagaaactcc

SEQ ID NO: 1001 - DNA, 19 bp, synthetic construct
  source 1..19: mol_type = other DNA
  misc_feature 1..5: note = RNA
  misc_feature 6: note = DNA
  misc_feature 7..8: note = RNA
  misc_feature 9: note = DNA
  misc_feature 10..17: note = RNA
  misc_feature 18: note = DNA
  misc_feature 19: note = RNA
gcgcctgctgcagaaactc

SEQ ID NO: 1002 - DNA, 19 bp, synthetic construct
  source 1..19: mol_type = other DNA
  misc_feature 1: note = DNA
  misc_feature 2..6: note = RNA
  misc_feature 7: note = DNA
  misc_feature 8..9: note = RNA
  misc_feature 10: note = DNA
  misc_feature 11..18: note = RNA
  misc_feature 19: note = DNA
tgcgcctgctgcagaaact

SEQ ID NO: 1003 - DNA, 19 bp, synthetic construct
  source 1..19: mol_type = other DNA
  misc_feature 1..2: note = DNA
  misc_feature 3..7: note = RNA
  misc_feature 8: note = DNA
  misc_feature 9..10: note = RNA
  misc_feature 11: note = DNA
  misc_feature 12..19: note = RNA
ttgcgcctgctgcagaaac

SEQ ID NO: 1004 - DNA, 19 bp, synthetic construct
  source 1..19: mol_type = other DNA
  misc_feature 1: note = RNA
  misc_feature 2..3: note = DNA
  misc_feature 4..8: note = RNA
  misc_feature 9: note = DNA
  misc_feature 10..11: note = RNA
  misc_feature 12: note = DNA
  misc_feature 13..19: note = RNA
gttgcgcctgctgcagaaa

SEQ ID NO: 1005 - DNA, 19 bp, synthetic construct
  source 1..19: mol_type = other DNA
  misc_feature 1..2: note = RNA
  misc_feature 3..4: note = DNA
  misc_feature 5..9: note = RNA
  misc_feature 10: note = DNA
  misc_feature 11..12: note = RNA
  misc_feature 13: note = DNA
  misc_feature 14..19: note = RNA
ggttgcgcctgctgcagaa

SEQ ID NO: 1006 - DNA, 19 bp, synthetic construct
  source 1..19: mol_type = other DNA
  misc_feature 1..3: note = RNA
  misc_feature 4..5: note = DNA
  misc_feature 6..10: note = RNA
  misc_feature 11: note = DNA
  misc_feature 12..13: note = RNA
  misc_feature 14: note = DNA
  misc_feature 15..19: note = RNA
aggttgcgcctgctgcaga

SEQ ID NO: 1007 - DNA, 19 bp, synthetic construct
  source 1..19: mol_type = other DNA
  misc_feature 1..4: note = RNA
  misc_feature 5..6: note = DNA
  misc_feature 7..11: note = RNA
  misc_feature 12: note = DNA
  misc_feature 13..14: note = RNA
  misc_feature 15: note = DNA
  misc_feature 16..19: note = RNA
gaggttgcgcctgctgcag

SEQ ID NO: 1008 - DNA, 19 bp, synthetic construct
  source 1..19: mol_type = other DNA
  misc_feature 1..5: note = RNA
  misc_feature 6..7: note = DNA
  misc_feature 8..12: note = RNA
  misc_feature 13: note = DNA
  misc_feature 14..15: note = RNA
  misc_feature 16: note = DNA
  misc_feature 17..19: note = RNA
agaggttgcgcctgctgca

SEQ ID NO: 1009 - DNA, 19 bp, synthetic construct
  source 1..19: mol_type = other DNA
  misc_feature 1..6: note = RNA
  misc_feature 7..8: note = DNA
  misc_feature 9..13: note = RNA
  misc_feature 14: note = DNA
  misc_feature 15..16: note = RNA
  misc_feature 17: note = DNA
  misc_feature 18..19: note = RNA
gagaggttgcgcctgctgc

SEQ ID NO: 1010 - DNA, 19 bp, synthetic construct
  source 1..19: mol_type = other DNA
  misc_feature 1..7: note = RNA
  misc_feature 8..9: note = DNA
  misc_feature 10..14: note = RNA
  misc_feature 15: note = DNA
  misc_feature 16..17: note = RNA
  misc_feature 18: note = DNA
  misc_feature 19: note = RNA
ggagaggttgcgcctgctg

SEQ ID NO: 1011 - DNA, 19 bp, synthetic construct
  source 1..19: mol_type = other DNA
  misc_feature 1..8: note = RNA
  misc_feature 9..10: note = DNA
  misc_feature 11..15: note = RNA
  misc_feature 16: note = DNA
  misc_feature 17..18: note = RNA
  misc_feature 19: note = DNA
aggagaggttgcgcctgct

SEQ ID NO: 1012 - DNA, 19 bp, synthetic construct
  source 1..19: mol_type = other DNA
  misc_feature 1: note = DNA
  misc_feature 2..9: note = RNA
  misc_feature 10..11: note = DNA
  misc_feature 12..16: note = RNA
  misc_feature 17: note = DNA
  misc_feature 18..19: note = RNA
taggagaggttgcgcctgc

SEQ ID NO: 1013 - DNA, 19 bp, synthetic construct
  source 1..19: mol_type = other DNA
  misc_feature 1: note = RNA
  misc_feature 2: note = DNA
  misc_feature 3..10: note = RNA
  misc_feature 11..12: note = DNA
  misc_feature 13..17: note = RNA
  misc_feature 18: note = DNA
  misc_feature 19: note = RNA
ctaggagaggttgcgcctg

SEQ ID NO: 1014 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..11: note = RNA
  misc_feature 12..13: note = DNA
  misc_feature 14..18: note = RNA
  misc_feature 19: note = DNA
tctaggagaggttgcgcct

SEQ ID NO: 1015 - DNA, 19 bp, synthetic construct
  source 1..19: mol_type = other DNA
  misc_feature 1..2: note = DNA
  misc_feature 3: note = RNA
  misc_feature 4: note = DNA
  misc_feature 5..12: note = RNA
  misc_feature 13..14: note = DNA
  misc_feature 15..19: note = RNA
ttctaggagaggttgcgcc

SEQ ID NO: 1016 - DNA, 19 bp, synthetic construct
  source 1..19: mol_type = other DNA
  misc_feature 1..3: note = DNA
  misc_feature 4: note = RNA
  misc_feature 5: note = DNA
  misc_feature 6..13: note = RNA
  misc_feature 14..15: note = DNA
  misc_feature 16..19: note = RNA
tttctaggagaggttgcgc

SEQ ID NO: 1017 - DNA, 19 bp, synthetic construct
  source 1..19: mol_type = other DNA
  misc_feature 1: note = RNA
  misc_feature 2..4: note = DNA
  misc_feature 5: note = RNA
  misc_feature 6: note = DNA
  misc_feature 7..14: note = RNA
  misc_feature 15..16: note = DNA
  misc_feature 17..19: note = RNA
gtttctaggagaggttgcg

SEQ ID NO: 1018 - DNA, 19 bp, synthetic construct
  source 1..19: mol_type = other DNA
  misc_feature 1..2: note = RNA
  misc_feature 3..5: note = DNA
  misc_feature 6: note = RNA
  misc_feature 7: note = DNA
  misc_feature 8..15: note = RNA
  misc_feature 16..17: note = DNA
  misc_feature 18..19: note = RNA
cgtttctaggagaggttgc

SEQ ID NO: 1019 - DNA, 19 bp, synthetic construct
  source 1..19: mol_type = other DNA
  misc_feature 1..3: note = RNA
  misc_feature 4..6: note = DNA
  misc_feature 7: note = RNA
  misc_feature 8: note = DNA
  misc_feature 9..16: note = RNA
  misc_feature 17..18: note = DNA
  misc_feature 19: note = RNA
ccgtttctaggagaggttg

SEQ ID NO: 1020 - DNA, 19 bp, synthetic construct
  source 1..19: mol_type = other DNA
  misc_feature 1: note = DNA
  misc_feature 2..4: note = RNA
  misc_feature 5..7: note = DNA
  misc_feature 8: note = RNA
  misc_feature 9: note = DNA
  misc_feature 10..17: note = RNA
  misc_feature 18..19: note = DNA
tccgtttctaggagaggtt

SEQ ID NO: 1021 - DNA, 19 bp, synthetic construct
  source 1..19: mol_type = other DNA
  misc_feature 1..6: note = RNA
  misc_feature 7: note = DNA
  misc_feature 8..10: note = RNA
  misc_feature 11..13: note = DNA
  misc_feature 14: note = RNA
  misc_feature 15: note = DNA
  misc_feature 16..19: note = RNA
ggggcctccgtttctagga

SEQ ID NO: 1022 - DNA, 19 bp, synthetic construct
  source 1..19: mol_type = other DNA
  misc_feature 1..7: note = RNA
  misc_feature 8: note = DNA
  misc_feature 9..11: note = RNA
  misc_feature 12..14: note = DNA
  misc_feature 15: note = RNA
  misc_feature 16: note = DNA
  misc_feature 17..19: note = RNA
cggggcctccgtttctagg

SEQ ID NO: 1023 - DNA, 19 bp, synthetic construct
  source 1..19: mol_type = other DNA
  misc_feature 1..8: note = RNA
  misc_feature 9: note = DNA
  misc_feature 10..12: note = RNA
  misc_feature 13..15: note = DNA
  misc_feature 16: note = RNA
  misc_feature 17: note = DNA
  misc_feature 18..19: note = RNA
ccggggcctccgtttctag

SEQ ID NO: 1024 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9: note = DNA
  misc_feature 10: note = RNA
  misc_feature 11: note = DNA
  misc_feature 12: note = RNA
  misc_feature 13: note = DNA
  misc_feature 14..19: note = RNA
gagtggagtctctcaccgg

SEQ ID NO: 1025 - DNA, 19 bp, synthetic construct
  source 1..19: mol_type = other DNA
  misc_feature 1..4: note = RNA
  misc_feature 5: note = DNA
  misc_feature 6..9: note = RNA
  misc_feature 10: note = DNA
  misc_feature 11: note = RNA
  misc_feature 12: note = DNA
  misc_feature 13: note = RNA
  misc_feature 14: note = DNA
  misc_feature 15..19: note = RNA
ggagtggagtctctcaccg

SEQ ID NO: 1026 - DNA, 19 bp, synthetic construct
  source 1..19: mol_type = other DNA
  misc_feature 1..5: note = RNA
  misc_feature 6: note = DNA
  misc_feature 7..10: note = RNA
  misc_feature 11: note = DNA
  misc_feature 12: note = RNA
  misc_feature 13: note = DNA
  misc_feature 14: note = RNA
  misc_feature 15: note = DNA
  misc_feature 16..19: note = RNA
cggagtggagtctctcacc

SEQ ID NO: 1027 - DNA, 19 bp, synthetic construct
  source 1..19: mol_type = other DNA
  misc_feature 1..3: note = DNA
  misc_feature 4..19: note = RNA
tttcacggaagaacaaggg

SEQ ID NO: 1028 - DNA, 19 bp, synthetic construct
  source 1..19: mol_type = other DNA
  misc_feature 1: note = RNA
  misc_feature 2..4: note = DNA
  misc_feature 5..19: note = RNA
atttcacggaagaacaagg

SEQ ID NO: 1029 - DNA, 19 bp, synthetic construct
  source 1..19: mol_type = other DNA
  misc_feature 1..2: note = RNA
  misc_feature 3..5: note = DNA
  misc_feature 6..19: note = RNA
aatttcacggaagaacaag

SEQ ID NO: 1030 - DNA, 19 bp, synthetic construct
  source 1..19: mol_type = other DNA
  misc_feature 1..3: note = RNA
  misc_feature 4..6: note = DNA
  misc_feature 7..19: note = RNA
gaatttcacggaagaacaa

SEQ ID NO: 1031 - DNA, 19 bp, synthetic construct
  source 1..19: mol_type = other DNA
  misc_feature 1..4: note = RNA
  misc_feature 5..7: note = DNA
  misc_feature 8..19: note = RNA
agaatttcacggaagaaca

SEQ ID NO: 1032 - DNA, 19 bp, synthetic construct
  source 1..19: mol_type = other DNA
  misc_feature 1..5: note = RNA
  misc_feature 6..8: note = DNA
  misc_feature 9..19: note = RNA
cagaatttcacggaagaac

SEQ ID NO: 1033 - DNA, 19 bp, synthetic construct
  source 1..19: mol_type = other DNA
  misc_feature 1..6: note = RNA
  misc_feature 7..9: note = DNA
  misc_feature 10..19: note = RNA
ccagaatttcacggaagaa

SEQ ID NO: 1034 - DNA, 19 bp, synthetic construct
  source 1..19: mol_type = other DNA
  misc_feature 1..7: note = RNA
  misc_feature 8..10: note = DNA
  misc_feature 11..19: note = RNA
gccagaatttcacggaaga

SEQ ID NO: 1035 - DNA, 19 bp, synthetic construct
  source 1..19: mol_type = other DNA
  misc_feature 1..8: note = RNA
  misc_feature 9..11: note = DNA
  misc_feature 12..19: note = RNA
agccagaatttcacggaag

SEQ ID NO: 1036 - DNA, 19 bp, synthetic construct
  source 1..19: mol_type = other DNA
  misc_feature 1..8: note = RNA
  misc_feature 9..10: note = DNA
  misc_feature 11..19: note = RNA
gggagacattcagccagaa

SEQ ID NO: 1037 - DNA, 19 bp, synthetic construct
  source 1..19: mol_type = other DNA
  misc_feature 1..9: note = RNA
  misc_feature 10..11: note = DNA
  misc_feature 12..19: note = RNA
ggggagacattcagccaga

SEQ ID NO: 1038 - DNA, 19 bp, synthetic construct
  source 1..19: mol_type = other DNA
  misc_feature 1..2: note = RNA
  misc_feature 3..5: note = DNA
  misc_feature 6..8: note = RNA
  misc_feature 9: note = DNA
  misc_feature 10..17: note = RNA
  misc_feature 18: note = DNA
  misc_feature 19: note = RNA
ggtttgcctagacagcgtc

SEQ ID NO: 1039 - DNA, 19 bp, synthetic construct
  source 1..19: mol_type = other DNA
  misc_feature 1..3: note = RNA
  misc_feature 4..6: note = DNA
  misc_feature 7..9: note = RNA
  misc_feature 10: note = DNA
  misc_feature 11..18: note = RNA
  misc_feature 19: note = DNA
aggtttgcctagacagcgt

SEQ ID NO: 1040 - DNA, 19 bp, synthetic construct
  source 1..19: mol_type = other DNA
  misc_feature 1..4: note = RNA
  misc_feature 5..7: note = DNA
  misc_feature 8..10: note = RNA
  misc_feature 11: note = DNA
  misc_feature 12..19: note = RNA
caggtttgcctagacagcg

SEQ ID NO: 1041 - DNA, 19 bp, synthetic construct
  source 1..19: mol_type = other DNA
  misc_feature 1..5: note = RNA
  misc_feature 6..8: note = DNA
  misc_feature 9..11: note = RNA
  misc_feature 12: note = DNA
  misc_feature 13..19: note = RNA
ccaggtttgcctagacagc

SEQ ID NO: 1042 - DNA, 19 bp, synthetic construct
  source 1..19: mol_type = other DNA
  misc_feature 1: note = DNA
  misc_feature 2..6: note = RNA
  misc_feature 7..9: note = DNA
  misc_feature 10..12: note = RNA
  misc_feature 13: note = DNA
  misc_feature 14..19: note = RNA
tccaggtttgcctagacag

SEQ ID NO: 1043 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8..10: note = DNA
  misc_feature 11..13: note = RNA
  misc_feature 14: note = DNA
  misc_feature 15..19: note = RNA
atccaggtttgcctagaca

SEQ ID NO: 1044 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9..11: note = DNA
  misc_feature 12..14: note = RNA
  misc_feature 15: note = DNA
  misc_feature 16..19: note = RNA
aatccaggtttgcctagac

SEQ ID NO: 1045 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..9: note = RNA
  misc_feature 10..12: note = DNA
  misc_feature 13..15: note = RNA
  misc_feature 16: note = DNA
  misc_feature 17..19: note = RNA
taatccaggtttgcctaga

SEQ ID NO: 1046 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..10: note = RNA
  misc_feature 11..13: note = DNA
  misc_feature 14..16: note = RNA
  misc_feature 17: note = DNA
  misc_feature 18..19: note = RNA
ctaatccaggtttgcctag

SEQ ID NO: 1047 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..5: note = RNA
  misc_feature 6: note = DNA
  misc_feature 7..11: note = RNA
  misc_feature 12..14: note = DNA
  misc_feature 15..17: note = RNA
  misc_feature 18: note = DNA
  misc_feature 19: note = RNA
tctaatccaggtttgccta

SEQ ID NO: 1048 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..6: note = RNA
  misc_feature 7: note = DNA
  misc_feature 8..12: note = RNA
  misc_feature 13..15: note = DNA
  misc_feature 16..18: note = RNA
  misc_feature 19: note = DNA
ctctaatccaggtttgcct

SEQ ID NO: 1049 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..7: note = RNA
  misc_feature 8: note = DNA
  misc_feature 9..13: note = RNA
  misc_feature 14..16: note = DNA
  misc_feature 17..19: note = RNA
actctaatccaggtttgcc

SEQ ID NO: 1050 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..8: note = RNA
  misc_feature 9: note = DNA
  misc_feature 10..14: note = RNA
  misc_feature 15..17: note = DNA
  misc_feature 18..19: note = RNA
aactctaatccaggtttgc

SEQ ID NO: 1051 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6: note = RNA
  misc_feature 7: note = DNA
  misc_feature 8..9: note = RNA
  misc_feature 10: note = DNA
  misc_feature 11..15: note = RNA
  misc_feature 16..18: note = DNA
  misc_feature 19: note = RNA
taactctaatccaggtttg

SEQ ID NO: 1052 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7: note = RNA
  misc_feature 8: note = DNA
  misc_feature 9..10: note = RNA
  misc_feature 11: note = DNA
  misc_feature 12..16: note = RNA
  misc_feature 17..19: note = DNA
gtaactctaatccaggttt

SEQ ID NO: 1053 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..6: note = RNA
  misc_feature 7: note = DNA
  misc_feature 8: note = RNA
  misc_feature 9: note = DNA
  misc_feature 10..11: note = RNA
  misc_feature 12: note = DNA
  misc_feature 13..17: note = RNA
  misc_feature 18..19: note = DNA
tgtaactctaatccaggtt

SEQ ID NO: 1054 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..7: note = RNA
  misc_feature 8: note = DNA
  misc_feature 9: note = RNA
  misc_feature 10: note = DNA
  misc_feature 11..12: note = RNA
  misc_feature 13: note = DNA
  misc_feature 14..18: note = RNA
  misc_feature 19: note = DNA
atgtaactctaatccaggt

SEQ ID NO: 1055 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6..8: note = RNA
  misc_feature 9: note = DNA
  misc_feature 10: note = RNA
  misc_feature 11: note = DNA
  misc_feature 12..13: note = RNA
  misc_feature 14: note = DNA
  misc_feature 15..19: note = RNA
gatgtaactctaatccagg

SEQ ID NO: 1056 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..9: note = RNA
  misc_feature 10: note = DNA
  misc_feature 11: note = RNA
  misc_feature 12: note = DNA
  misc_feature 13..14: note = RNA
  misc_feature 15: note = DNA
  misc_feature 16..19: note = RNA
agatgtaactctaatccag

SEQ ID NO: 1057 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..10: note = RNA
  misc_feature 11: note = DNA
  misc_feature 12: note = RNA
  misc_feature 13: note = DNA
  misc_feature 14..15: note = RNA
  misc_feature 16: note = DNA
  misc_feature 17..19: note = RNA
gagatgtaactctaatcca

SEQ ID NO: 1058 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..11: note = RNA
  misc_feature 12: note = DNA
  misc_feature 13: note = RNA
  misc_feature 14: note = DNA
  misc_feature 15..16: note = RNA
  misc_feature 17: note = DNA
  misc_feature 18..19: note = RNA
ggagatgtaactctaatcc

SEQ ID NO: 1059 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..12: note = RNA
  misc_feature 13: note = DNA
  misc_feature 14: note = RNA
  misc_feature 15: note = DNA
  misc_feature 16..17: note = RNA
  misc_feature 18: note = DNA
  misc_feature 19: note = RNA
aggagatgtaactctaatc

SEQ ID NO: 1060 - DNA, 19 bp, synthetic construct
  source 1..19: mol_type = other DNA
  misc_feature 1..7: note = RNA
  misc_feature 8: note = DNA
  misc_feature 9: note = RNA
  misc_feature 10: note = DNA
  misc_feature 11..13: note = RNA
  misc_feature 14: note = DNA
  misc_feature 15: note = RNA
  misc_feature 16: note = DNA
  misc_feature 17..18: note = RNA
  misc_feature 19: note = DNA
caggagatgtaactctaat

SEQ ID NO: 1061 - DNA, 19 bp, synthetic construct
  source 1..19: mol_type = other DNA
  misc_feature 1..8: note = RNA
  misc_feature 9: note = DNA
  misc_feature 10: note = RNA
  misc_feature 11: note = DNA
  misc_feature 12..14: note = RNA
  misc_feature 15: note = DNA
  misc_feature 16: note = RNA
  misc_feature 17: note = DNA
  misc_feature 18..19: note = RNA
ccaggagatgtaactctaa

SEQ ID NO: 1062 - DNA, 19 bp, synthetic construct
  source 1..19: mol_type = other DNA
  misc_feature 1: note = DNA
  misc_feature 2..9: note = RNA
  misc_feature 10: note = DNA
  misc_feature 11: note = RNA
  misc_feature 12: note = DNA
  misc_feature 13..15: note = RNA
  misc_feature 16: note = DNA
  misc_feature 17: note = RNA
  misc_feature 18: note = DNA
  misc_feature 19: note = RNA
tccaggagatgtaactcta

SEQ ID NO: 1063 - DNA, 19 bp, synthetic construct
  source 1..19: mol_type = other DNA
  misc_feature 1: note = RNA
  misc_feature 2: note = DNA
  misc_feature 3..10: note = RNA
  misc_feature 11: note = DNA
  misc_feature 12: note = RNA
  misc_feature 13: note = DNA
  misc_feature 14..16: note = RNA
  misc_feature 17: note = DNA
  misc_feature 18: note = RNA
  misc_feature 19: note = DNA
atccaggagatgtaactct

SEQ ID NO: 1064 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..9: note = RNA
  misc_feature 10: note = DNA
  misc_feature 11..18: note = RNA
  misc_feature 19: note = DNA
aactaatcatccaggagat

SEQ ID NO: 1065 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8: note = DNA
  misc_feature 9..10: note = RNA
  misc_feature 11: note = DNA
  misc_feature 12..19: note = RNA
gaactaatcatccaggaga

SEQ ID NO: 1066 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7..8: note = RNA
  misc_feature 9: note = DNA
  misc_feature 10..11: note = RNA
  misc_feature 12: note = DNA
  misc_feature 13..19: note = RNA
tgaactaatcatccaggag

SEQ ID NO: 1067 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8..9: note = RNA
  misc_feature 10: note = DNA
  misc_feature 11..12: note = RNA
  misc_feature 13: note = DNA
  misc_feature 14..19: note = RNA
ctgaactaatcatccagga

SEQ ID NO: 1068 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..7: note = RNA
  misc_feature 8: note = DNA
  misc_feature 9..10: note = RNA
  misc_feature 11: note = DNA
  misc_feature 12..13: note = RNA
  misc_feature 14: note = DNA
  misc_feature 15..19: note = RNA
tctgaactaatcatccagg

SEQ ID NO: 1069 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..8: note = RNA
  misc_feature 9: note = DNA
  misc_feature 10..11: note = RNA
  misc_feature 12: note = DNA
  misc_feature 13..14: note = RNA
  misc_feature 15: note = DNA
  misc_feature 16..19: note = RNA
ctctgaactaatcatccag

SEQ ID NO: 1070 - DNA, 19 bp, synthetic construct
  source 1..19: mol_type = other DNA
  misc_feature 1..2: note = RNA
  misc_feature 3..4: note = DNA
  misc_feature 5..16: note = RNA
  misc_feature 17: note = DNA
  misc_feature 18..19: note = RNA
gcttccgcggggagggtgc

SEQ ID NO: 1071 - DNA, 19 bp, synthetic construct
  source 1..19: mol_type = other DNA
  misc_feature 1..3: note = RNA
  misc_feature 4..5: note = DNA
  misc_feature 6..17: note = RNA
  misc_feature 18: note = DNA
  misc_feature 19: note = RNA
ggcttccgcggggagggtg

SEQ ID NO: 1072 - DNA, 19 bp, synthetic construct
  source 1..19: mol_type = other DNA
  misc_feature 1..4: note = RNA
  misc_feature 5..6: note = DNA
  misc_feature 7..18: note = RNA
  misc_feature 19: note = DNA
gggcttccgcggggagggt

SEQ ID NO: 1073 - DNA, 19 bp, synthetic construct
  source 1..19: mol_type = other DNA
  misc_feature 1..6: note = RNA
  misc_feature 7..8: note = DNA
  misc_feature 9..19: note = RNA
ccgggcttccgcggggagg

SEQ ID NO: 1074 - DNA, 19 bp, synthetic construct
  source 1..19: mol_type = other DNA
  misc_feature 1..2: note = RNA
  misc_feature 3: note = DNA
  misc_feature 4..11: note = RNA
  misc_feature 12..13: note = DNA
  misc_feature 14..19: note = RNA
cgtccccgggcttccgcgg

SEQ ID NO: 1075 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..13: note = RNA
  misc_feature 14..15: note = DNA
  misc_feature 16..19: note = RNA
ctcgtccccgggcttccgc

SEQ ID NO: 1076 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..14: note = RNA
  misc_feature 15..16: note = DNA
  misc_feature 17..19: note = RNA
cctcgtccccgggcttccg

SEQ ID NO: 1077 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..5: note = RNA
  misc_feature 6..7: note = DNA
  misc_feature 8: note = RNA
  misc_feature 9: note = DNA
  misc_feature 10..18: note = RNA
  misc_feature 19: note = DNA
tctcattctgaaaccaaat

SEQ ID NO: 1078 - DNA, 19 bp, synthetic construct
  source 1..19: mol_type = other DNA
  misc_feature 1..8: note = RNA
  misc_feature 9..10: note = DNA
  misc_feature 11..18: note = RNA
  misc_feature 19: note = DNA
ggccgagattcccgccggt

SEQ ID NO: 1079 - DNA, 19 bp, synthetic construct
  source 1..19: mol_type = other DNA
  misc_feature 1..4: note = RNA
  misc_feature 5: note = DNA
  misc_feature 6: note = RNA
  misc_feature 7: note = DNA
  misc_feature 8..19: note = RNA
cgcgtctcccgggccaggg

SEQ ID NO: 1080 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..19: note = RNA
ccgcgtctcccgggccagg

SEQ ID NO: 1081 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..19: note = RNA
gccgcgtctcccgggccag

SEQ ID NO: 1082 - DNA, 19 bp, synthetic construct
  source 1..19: mol_type = other DNA
  misc_feature 1..2: note = RNA
  misc_feature 3..4: note = DNA
  misc_feature 5: note = RNA
  misc_feature 6: note = DNA
  misc_feature 7..17: note = RNA
  misc_feature 18: note = DNA
  misc_feature 19: note = RNA
ccttctggcgggccgcgtc

SEQ ID NO: 1083 - DNA, 19 bp, synthetic construct
  source 1..19: mol_type = other DNA
  misc_feature 1..3: note = RNA
  misc_feature 4..5: note = DNA
  misc_feature 6: note = RNA
  misc_feature 7: note = DNA
  misc_feature 8..18: note = RNA
  misc_feature 19: note = DNA
gccttctggcgggccgcgt

SEQ ID NO: 1084 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8..10: note = DNA
  misc_feature 11..18: note = RNA
  misc_feature 19: note = DNA
ggtccgctttcgccggcct

SEQ ID NO: 1085 - DNA, 19 bp, synthetic construct
  source 1..19: mol_type = other DNA
  misc_feature 1..3: note = RNA
  misc_feature 4: note = DNA
  misc_feature 5..8: note = RNA
  misc_feature 9..11: note = DNA
  misc_feature 12..19: note = RNA
cggtccgctttcgccggcc

SEQ ID NO: 1086 - DNA, 19 bp, synthetic construct
  source 1..19: mol_type = other DNA
  misc_feature 1..4: note = RNA
  misc_feature 5: note = DNA
  misc_feature 6..9: note = RNA
  misc_feature 10..12: note = DNA
  misc_feature 13..19: note = RNA
gcggtccgctttcgccggc

SEQ ID NO: 1087 - DNA, 19 bp, synthetic construct
  source 1..19: mol_type = other DNA
  misc_feature 1..2: note = RNA
  misc_feature 3: note = DNA
  misc_feature 4..19: note = RNA
gctcggaggagcagggcgg

SEQ ID NO: 1088 - DNA, 19 bp, synthetic construct
  source 1..19: mol_type = other DNA
  misc_feature 1..12: note = RNA
  misc_feature 13: note = DNA
  misc_feature 14..16: note = RNA
  misc_feature 17: note = DNA
  misc_feature 18..19: note = RNA
cccgggcggcgatgcctgg

SEQ ID NO: 1089 - DNA, 19 bp, synthetic construct
  source 1..19: mol_type = other DNA
  misc_feature 1: note = DNA
  misc_feature 2..3: note = RNA
  misc_feature 4: note = DNA
  misc_feature 5..16: note = RNA
  misc_feature 17: note = DNA
  misc_feature 18..19: note = RNA
tcctcccgggcggcgatgc

SEQ ID NO: 1090 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..17: note = RNA
  misc_feature 18: note = DNA
  misc_feature 19: note = RNA
ctcctcccgggcggcgatg

SEQ ID NO: 1091 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..18: note = RNA
  misc_feature 19: note = DNA
gctcctcccgggcggcgat

SEQ ID NO: 1092 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..19: note = RNA
agctcctcccgggcggcga

SEQ ID NO: 1093 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8: note = DNA
  misc_feature 9..19: note = RNA
cagctcctcccgggcggcg

SEQ ID NO: 1094 - DNA, 19 bp, synthetic construct
  source 1..19: mol_type = other DNA
  misc_feature 1: note = DNA
  misc_feature 2: note = RNA
  misc_feature 3: note = DNA
  misc_feature 4..9: note = RNA
  misc_feature 10: note = DNA
  misc_feature 11..13: note = RNA
  misc_feature 14: note = DNA
  misc_feature 15..19: note = RNA
tgtcccgggtgcctggccc

SEQ ID NO: 1095 - DNA, 19 bp, synthetic construct
  source 1..19: mol_type = other DNA
  misc_feature 1..7: note = RNA
  misc_feature 8: note = DNA
  misc_feature 9..15: note = RNA
  misc_feature 16: note = DNA
  misc_feature 17: note = RNA
  misc_feature 18: note = DNA
  misc_feature 19: note = RNA
ggcgccctgccaccctgtc

SEQ ID NO: 1096 - DNA, 19 bp, synthetic construct
  source 1..19: mol_type = other DNA
  misc_feature 1..8: note = RNA
  misc_feature 9: note = DNA
  misc_feature 10..16: note = RNA
  misc_feature 17: note = DNA
  misc_feature 18: note = RNA
  misc_feature 19: note = DNA
gggcgccctgccaccctgt

SEQ ID NO: 1097 - DNA, 19 bp, synthetic construct
  source 1..19: mol_type = other DNA
  misc_feature 1..10: note = RNA
  misc_feature 11: note = DNA
  misc_feature 12..18: note = RNA
  misc_feature 19: note = DNA
gcgggcgccctgccaccct

SEQ ID NO: 1098 - DNA, 19 bp, synthetic construct
  source 1..19: mol_type = other DNA
  misc_feature 1..11: note = RNA
  misc_feature 12: note = DNA
  misc_feature 13..19: note = RNA
cgcgggcgccctgccaccc

SEQ ID NO: 1099 - DNA, 19 bp, synthetic construct
  source 1..19: mol_type = other DNA
  misc_feature 1: note = DNA
  misc_feature 2..13: note = RNA
  misc_feature 14: note = DNA
  misc_feature 15..19: note = RNA
tgcgcgggcgccctgccac

SEQ ID NO: 1100 - DNA, 19 bp, synthetic construct
  source 1..19: mol_type = other DNA
  misc_feature 1..5: note = RNA
  misc_feature 6: note = DNA
  misc_feature 7..18: note = RNA
  misc_feature 19: note = DNA
cgcgctgcacaggccgcct

SEQ ID NO: 1101 - DNA, 19 bp, synthetic construct
  source 1..19: mol_type = other DNA
  misc_feature 1..6: note = RNA
  misc_feature 7: note = DNA
  misc_feature 8..19: note = RNA
ccgcgctgcacaggccgcc

SEQ ID NO: 1102 - DNA, 19 bp, synthetic construct
  source 1..19: mol_type = other DNA
  misc_feature 1..7: note = RNA
  misc_feature 8: note = DNA
  misc_feature 9..19: note = RNA
gccgcgctgcacaggccgc

SEQ ID NO: 1103 - DNA, 19 bp, synthetic construct
  source 1..19: mol_type = other DNA
  misc_feature 1..5: note = RNA
  misc_feature 6: note = DNA
  misc_feature 7: note = RNA
  misc_feature 8: note = DNA
  misc_feature 9..19: note = RNA
gccggtgtgggcgaaggcg

SEQ ID NO: 1104 - DNA, 19 bp, synthetic construct
  source 1..19: mol_type = other DNA
  misc_feature 1..2: note = RNA
  misc_feature 3..4: note = DNA
  misc_feature 5..17: note = RNA
  misc_feature 18: note = DNA
  misc_feature 19: note = RNA
cgttccccacgcgccggtg

SEQ ID NO: 1105 - DNA, 19 bp, synthetic construct
  source 1..19: mol_type = other DNA
  misc_feature 1..3: note = RNA
  misc_feature 4..5: note = DNA
  misc_feature 6..18: note = RNA
  misc_feature 19: note = DNA
ccgttccccacgcgccggt

SEQ ID NO: 1106 - DNA, 19 bp, synthetic construct
  source 1..19: mol_type = other DNA
  misc_feature 1..4: note = RNA
  misc_feature 5..6: note = DNA
  misc_feature 7..19: note = RNA
cccgttccccacgcgccgg

SEQ ID NO: 1107 - DNA, 19 bp, synthetic construct
  source 1..19: mol_type = other DNA
  misc_feature 1..5: note = RNA
  misc_feature 6..7: note = DNA
  misc_feature 8..19: note = RNA
ccccgttccccacgcgccg

SEQ ID NO: 1108 - DNA, 19 bp, synthetic construct
  source 1..19: mol_type = other DNA
  misc_feature 1..7: note = RNA
  misc_feature 8..9: note = DNA
  misc_feature 10..19: note = RNA
agccccgttccccacgcgc

SEQ ID NO: 1109 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9..19: note = RNA
cgtggggtgcgggaagccc

SEQ ID NO: 1110 - DNA, 19 bp, synthetic construct
  source 1..19: mol_type = other DNA
  misc_feature 1..12: note = RNA
  misc_feature 13: note = DNA
  misc_feature 14..17: note = RNA
  misc_feature 18: note = DNA
  misc_feature 19: note = RNA
gcgcagggcacgtggggtg

SEQ ID NO: 1111 - DNA, 19 bp, synthetic construct
  source 1..19: mol_type = other DNA
  misc_feature 1..14: note = RNA
  misc_feature 15: note = DNA
  misc_feature 16..19: note = RNA
gcgcgcagggcacgtgggg

SEQ ID NO: 1112 - DNA, 19 bp, synthetic construct
  source 1..19: mol_type = other DNA
  misc_feature 1..16: note = RNA
  misc_feature 17: note = DNA
  misc_feature 18..19: note = RNA
aggcgcgcagggcacgtgg

SEQ ID NO: 1113 - DNA, 19 bp, synthetic construct
  source 1..19: mol_type = other DNA
  misc_feature 1..18: note = RNA
  misc_feature 19: note = DNA
ccaggcgcgcagggcacgt

SEQ ID NO: 1114 - RNA, 19 nt, synthetic construct
  source 1..19: mol_type = other RNA
gagagccccaggcgcgcag

SEQ ID NO: 1115 - DNA, 19 bp, synthetic construct
  source 1..19: mol_type = other DNA
  misc_feature 1: note = RNA
  misc_feature 2: note = DNA
  misc_feature 3..5: note = RNA
  misc_feature 6: note = DNA
  misc_feature 7..9: note = RNA
  misc_feature 10: note = DNA
  misc_feature 11..19: note = RNA
ctgcctggctcacgaaagc

SEQ ID NO: 1116 - DNA, 19 bp, synthetic construct
  source 1..19: mol_type = other DNA
  misc_feature 1..2: note = RNA
  misc_feature 3: note = DNA
  misc_feature 4..6: note = RNA
  misc_feature 7: note = DNA
  misc_feature 8..10: note = RNA
  misc_feature 11: note = DNA
  misc_feature 12..19: note = RNA
gctgcctggctcacgaaag

SEQ ID NO: 1117 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8: note = DNA
  misc_feature 9..11: note = RNA
  misc_feature 12: note = DNA
  misc_feature 13..19: note = RNA
cgctgcctggctcacgaaa

SEQ ID NO: 1118 - DNA, 19 bp, synthetic construct
  source 1..19: mol_type = other DNA
  misc_feature 1..8: note = RNA
  misc_feature 9: note = DNA
  misc_feature 10..12: note = RNA
  misc_feature 13: note = DNA
  misc_feature 14..16: note = RNA
  misc_feature 17: note = DNA
  misc_feature 18..19: note = RNA
ggcggccctcgctgcctgg

SEQ ID NO: 1119 - DNA, 19 bp, synthetic construct
  source 1..19: mol_type = other DNA
  misc_feature 1..5: note = RNA
  misc_feature 6: note = DNA
  misc_feature 7..9: note = RNA
  misc_feature 10: note = DNA
  misc_feature 11..14: note = RNA
  misc_feature 15: note = DNA
  misc_feature 16..19: note = RNA
cggcctggctgggctgcag

SEQ ID NO: 1120 - DNA, 19 bp, synthetic construct
  source 1..19: mol_type = other DNA
  misc_feature 1..7: note = RNA
  misc_feature 8: note = DNA
  misc_feature 9..11: note = RNA
  misc_feature 12: note = DNA
  misc_feature 13..16: note = RNA
  misc_feature 17: note = DNA
  misc_feature 18..19: note = RNA
cgcggcctggctgggctgc

SEQ ID NO: 1121 - DNA, 19 bp, synthetic construct
  source 1..19: mol_type = other DNA
  misc_feature 1..12: note = RNA
  misc_feature 13: note = DNA
  misc_feature 14..16: note = RNA
  misc_feature 17: note = DNA
  misc_feature 18..19: note = RNA
gccggcgcggcctggctgg

SEQ ID NO: 1122 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8: note = RNA
  misc_feature 9: note = DNA
  misc_feature 10..19: note = RNA
atcccctctgccggcgcgg

SEQ ID NO: 1123 - DNA, 19 bp, synthetic construct
  source 1..19: mol_type = other DNA
  misc_feature 1..15: note = RNA
  misc_feature 16..17: note = DNA
  misc_feature 18..19: note = RNA
gcgcgccggggcaggttgg

SEQ ID NO: 1124 - DNA, 19 bp, synthetic construct
  source 1..19: mol_type = other DNA
  misc_feature 1..17: note = RNA
  misc_feature 18..19: note = DNA
ccgcgcgccggggcaggtt

SEQ ID NO: 1125 - DNA, 19 bp, synthetic construct
  source 1..19: mol_type = other DNA
  misc_feature 1: note = RNA
  misc_feature 2: note = DNA
  misc_feature 3..10: note = RNA
  misc_feature 11: note = DNA
  misc_feature 12..19: note = RNA
gtaggcgaaatccccgcgc

SEQ ID NO: 1126 - DNA, 19 bp, synthetic construct
  source 1..19: mol_type = other DNA
  misc_feature 1..11: note = RNA
  misc_feature 12: note = DNA
  misc_feature 13..19: note = RNA
ccggggcggcgtaggcgaa

SEQ ID NO: 1127 - DNA, 19 bp, synthetic construct
  source 1..19: mol_type = other DNA
  misc_feature 1..13: note = RNA
  misc_feature 14: note = DNA
  misc_feature 15..19: note = RNA
agccggggcggcgtaggcg

SEQ ID NO: 1128 - DNA, 19 bp, synthetic construct
  source 1..19: mol_type = other DNA
  misc_feature 1..7: note = RNA
  misc_feature 8: note = DNA
  misc_feature 9..19: note = RNA
cgccccgtccggaggagcc

SEQ ID NO: 1129 - DNA, 19 bp, synthetic construct
  source 1..19: mol_type = other DNA
  misc_feature 1..8: note = RNA
  misc_feature 9: note = DNA
  misc_feature 10..19: note = RNA
gcgccccgtccggaggagc

SEQ ID NO: 1130 - DNA, 19 bp, synthetic construct
  source 1..19: mol_type = other DNA
  misc_feature 1..5: note = RNA
  misc_feature 6: note = DNA
  misc_feature 7..19: note = RNA
gagggtgggagagcgcccc

SEQ ID NO: 1131 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9: note = DNA
  misc_feature 10..14: note = RNA
  misc_feature 15: note = DNA
  misc_feature 16..17: note = RNA
  misc_feature 18: note = DNA
  misc_feature 19: note = RNA
gctgcgggtcccggtcctc

SEQ ID NO: 1132 - DNA, 19 bp, synthetic construct
  source 1..19: mol_type = other DNA
  misc_feature 1..3: note = RNA
  misc_feature 4: note = DNA
  misc_feature 5..9: note = RNA
  misc_feature 10: note = DNA
  misc_feature 11..15: note = RNA
  misc_feature 16: note = DNA
  misc_feature 17..19: note = RNA
ccgtcgcgctgcgggtccc

SEQ ID NO: 1133 - DNA, 19 bp, synthetic construct
  source 1..19: mol_type = other DNA
  misc_feature 1..7: note = RNA
  misc_feature 8: note = DNA
  misc_feature 9..13: note = RNA
  misc_feature 14: note = DNA
  misc_feature 15..19: note = RNA
caggccgtcgcgctgcggg

SEQ ID NO: 1134 - RNA, 19 nt, synthetic construct
  source 1..19: mol_type = other RNA
gcgcaggggcccggcaggc

SEQ ID NO: 1135 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..19: note = RNA
ggctgtgccaccgcgcagg

SEQ ID NO: 1136 - DNA, 19 bp, synthetic construct
  source 1..19: mol_type = other DNA
  misc_feature 1..6: note = RNA
  misc_feature 7: note = DNA
  misc_feature 8: note = RNA
  misc_feature 9: note = DNA
  misc_feature 10..19: note = RNA
ccaggctgtgccaccgcgc

SEQ ID NO: 1137 - DNA, 19 bp, synthetic construct
  source 1..19: mol_type = other DNA
  misc_feature 1..7: note = RNA
  misc_feature 8: note = DNA
  misc_feature 9: note = RNA
  misc_feature 10: note = DNA
  misc_feature 11..19: note = RNA
cccaggctgtgccaccgcg

SEQ ID NO: 1138 - DNA, 19 bp, synthetic construct
  source 1..19: mol_type = other DNA
  misc_feature 1..9: note = RNA
  misc_feature 10: note = DNA
  misc_feature 11: note = RNA
  misc_feature 12: note = DNA
  misc_feature 13..19: note = RNA
ggcccaggctgtgccaccg

SEQ ID NO: 1139 - DNA, 19 bp, synthetic construct
  source 1..19: mol_type = other DNA
  misc_feature 1..14: note = RNA
  misc_feature 15: note = DNA
  misc_feature 16: note = RNA
  misc_feature 17: note = DNA
  misc_feature 18..19: note = RNA
gagcgggcccaggctgtgc

SEQ ID NO: 1140 - DNA, 19 bp, synthetic construct
  source 1..19: mol_type = other DNA
  misc_feature 1..4: note = RNA
  misc_feature 5..6: note = DNA
  misc_feature 7..19: note = RNA
ccgcttgagcgggcccagg

SEQ ID NO: 1141 - DNA, 19 bp, synthetic construct
  source 1..19: mol_type = other DNA
  misc_feature 1..7: note = RNA
  misc_feature 8..9: note = DNA
  misc_feature 10..14: note = RNA
  misc_feature 15: note = DNA
  misc_feature 16..19: note = RNA
gcaccccttggccctgcgg

SEQ ID NO: 1142 - DNA, 19 bp, synthetic construct
  source 1..19: mol_type = other DNA
  misc_feature 1..3: note = RNA
  misc_feature 4: note = DNA
  misc_feature 5..7: note = RNA
  misc_feature 8: note = DNA
  misc_feature 9..19: note = RNA
acgtgggtggcgcaagcac

SEQ ID NO: 1143 - DNA, 19 bp, synthetic construct
  source 1..19: mol_type = other DNA
  misc_feature 1..4: note = RNA
  misc_feature 5: note = DNA
  misc_feature 6..8: note = RNA
  misc_feature 9: note = DNA
  misc_feature 10..19: note = RNA
gacgtgggtggcgcaagca

SEQ ID NO: 1144 - DNA, 19 bp, synthetic construct
  source 1..19: mol_type = other DNA
  misc_feature 1..5: note = RNA
  misc_feature 6: note = DNA
  misc_feature 7..9: note = RNA
  misc_feature 10: note = DNA
  misc_feature 11..19: note = RNA
ggacgtgggtggcgcaagc

SEQ ID NO: 1145 - DNA, 19 bp, synthetic construct
  source 1..19: mol_type = other DNA
  misc_feature 1..6: note = RNA
  misc_feature 7: note = DNA
  misc_feature 8..10: note = RNA
  misc_feature 11: note = DNA
  misc_feature 12..19: note = RNA
gggacgtgggtggcgcaag

SEQ ID NO: 1146 - DNA, 19 bp, synthetic construct
  source 1..19: mol_type = other DNA
  misc_feature 1: note = RNA
  misc_feature 2: note = DNA
  misc_feature 3..8: note = RNA
  misc_feature 9: note = DNA
  misc_feature 10..12: note = RNA
  misc_feature 13: note = DNA
  misc_feature 14..19: note = RNA
ctgggacgtgggtggcgca

SEQ ID NO: 1147 - DNA, 19 bp, synthetic construct
  source 1..19: mol_type = other DNA
  misc_feature 1..18: note = RNA
  misc_feature 19: note = DNA
cccagccccaccacggact

SEQ ID NO: 1148 - DNA, 19 bp, synthetic construct
  source 1..19: mol_type = other DNA
  misc_feature 1..4: note = RNA
  misc_feature 5: note = DNA
  misc_feature 6..19: note = RNA
gacctggggaccccggccc

SEQ ID NO: 1149 - DNA, 19 bp, synthetic construct
  source 1..19: mol_type = other DNA
  misc_feature 1..7: note = RNA
  misc_feature 8: note = DNA
  misc_feature 9..19: note = RNA
ggcgacctggggaccccgg

SEQ ID NO: 1150 - DNA, 19 bp, synthetic construct
  source 1..19: mol_type = other DNA
  misc_feature 1..2: note = RNA
  misc_feature 3..4: note = DNA
  misc_feature 5..19: note = RNA
ggttcccacgccgccccgg

SEQ ID NO: 1151 - DNA, 19 bp, synthetic construct
  source 1..19: mol_type = other DNA
  misc_feature 1..6: note = RNA
  misc_feature 7: note = DNA
  misc_feature 8..14: note = RNA
  misc_feature 15: note = DNA
  misc_feature 16..19: note = RNA
gcgggctggggaggtggag

SEQ ID NO: 1152 - DNA, 19 bp, synthetic construct
  source 1..19: mol_type = other DNA
  misc_feature 1..9: note = RNA
  misc_feature 10: note = DNA
  misc_feature 11..17: note = RNA
  misc_feature 18: note = DNA
  misc_feature 19: note = RNA
ggcgcgggctggggaggtg

SEQ ID NO: 1153 - DNA, 19 bp, synthetic construct
  source 1..19: mol_type = other DNA
  misc_feature 1..11: note = RNA
  misc_feature 12: note = DNA
  misc_feature 13..19: note = RNA
ggggcgcgggctggggagg

SEQ ID NO: 1154 - DNA, 19 bp, synthetic construct
  source 1..19: mol_type = other DNA
  misc_feature 1..4: note = RNA
  misc_feature 5: note = DNA
  misc_feature 6..19: note = RNA
cccctgccgcgcggaggcg

SEQ ID NO: 1155 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..9: note = RNA
  misc_feature 10: note = DNA
  misc_feature 11..19: note = RNA
atctgcccctgccgcgcgg

SEQ ID NO: 1156 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6: note = DNA
  misc_feature 7..11: note = RNA
  misc_feature 12: note = DNA
  misc_feature 13..19: note = RNA
gcatctgcccctgccgcgc

SEQ ID NO: 1157 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7: note = DNA
  misc_feature 8..15: note = RNA
  misc_feature 16: note = DNA
  misc_feature 17..19: note = RNA
ggctcctggagcgcctggg

SEQ ID NO: 1158 - DNA, 19 bp, synthetic construct
  source 1..19: mol_type = other DNA
  misc_feature 1..17: note = RNA
  misc_feature 18: note = DNA
  misc_feature 19: note = RNA
cagaccagggcgccggctc

SEQ ID NO: 1159 - DNA, 19 bp, synthetic construct
  source 1..19: mol_type = other DNA
  misc_feature 1: note = DNA
  misc_feature 2..19: note = RNA
tgcagaccagggcgccggc

SEQ ID NO: 1160 - DNA, 19 bp, synthetic construct
  source 1..19: mol_type = other DNA
  misc_feature 1: note = RNA
  misc_feature 2: note = DNA
  misc_feature 3..19: note = RNA
gtgcagaccagggcgccgg

SEQ ID NO: 1161 - DNA, 19 bp, synthetic construct
  source 1..19: mol_type = other DNA
  misc_feature 1..2: note = RNA
  misc_feature 3: note = DNA
  misc_feature 4..19: note = RNA
agtgcagaccagggcgccg

SEQ ID NO: 1162 - RNA, 19 nt, synthetic construct
  source 1..19: mol_type = other RNA
gcagcaggccgcaggggag

SEQ ID NO: 1163 - DNA, 19 bp, synthetic construct
  source 1..19: mol_type = other DNA
  misc_feature 1: note = DNA
  misc_feature 2..11: note = RNA
  misc_feature 12: note = DNA
  misc_feature 13..14: note = RNA
  misc_feature 15: note = DNA
  misc_feature 16..19: note = RNA
tcgccaggagctcatccag

SEQ ID NO: 1164 - DNA, 19 bp, synthetic construct
  source 1..19: mol_type = other DNA
  misc_feature 1..8: note = RNA
  misc_feature 9: note = DNA
  misc_feature 10..14: note = RNA
  misc_feature 15: note = DNA
  misc_feature 16..19: note = RNA
ccgaggcctccagctcccc

SEQ ID NO: 1165 - DNA, 19 bp, synthetic construct
  source 1..19: mol_type = other DNA
  misc_feature 1: note = RNA
  misc_feature 2..3: note = DNA
  misc_feature 4..11: note = RNA
  misc_feature 12: note = DNA
  misc_feature 13..17: note = RNA
  misc_feature 18: note = DNA
  misc_feature 19: note = RNA
cttccgaggcctccagctc

SEQ ID NO: 1166 - DNA, 19 bp, synthetic construct
  source 1..19: mol_type = other DNA
  misc_feature 1: note = DNA
  misc_feature 2: note = RNA
  misc_feature 3..4: note = DNA
  misc_feature 5..12: note = RNA
  misc_feature 13: note = DNA
  misc_feature 14..18: note = RNA
  misc_feature 19: note = DNA
tcttccgaggcctccagct

SEQ ID NO: 1167 - DNA, 19 bp, synthetic construct
  source 1..19: mol_type = other DNA
  misc_feature 1: note = RNA
  misc_feature 2: note = DNA
  misc_feature 3: note = RNA
  misc_feature 4..5: note = DNA
  misc_feature 6..13: note = RNA
  misc_feature 14: note = DNA
  misc_feature 15..19: note = RNA
ctcttccgaggcctccagc

SEQ ID NO: 1168 - DNA, 19 bp, synthetic construct
  source 1..19: mol_type = other DNA
  misc_feature 1: note = DNA
  misc_feature 2..3: note = RNA
  misc_feature 4..5: note = DNA
  misc_feature 6..19: note = RNA
tgcttccagcgaggcggcc

SEQ ID NO: 1169 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5..6: note = DNA
  misc_feature 7..19: note = RNA
gtgcttccagcgaggcggc

SEQ ID NO: 1170 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6..7: note = DNA
  misc_feature 8..19: note = RNA
ggtgcttccagcgaggcgg

SEQ ID NO: 1171 - DNA, 19 bp, synthetic construct
  source 1..19: mol_type = other DNA
  misc_feature 1..3: note = RNA
  misc_feature 4: note = DNA
  misc_feature 5..6: note = RNA
  misc_feature 7..8: note = DNA
  misc_feature 9..19: note = RNA
gggtgcttccagcgaggcg

SEQ ID NO: 1172 - DNA, 19 bp, synthetic construct
  source 1..19: mol_type = other DNA
  misc_feature 1..4: note = RNA
  misc_feature 5: note = DNA
  misc_feature 6..7: note = RNA
  misc_feature 8..9: note = DNA
  misc_feature 10..19: note = RNA
ggggtgcttccagcgaggc

SEQ ID NO: 1173 - DNA, 19 bp, synthetic construct
  source 1..19: mol_type = other DNA
  misc_feature 1..6: note = RNA
  misc_feature 7: note = DNA
  misc_feature 8..9: note = RNA
  misc_feature 10..11: note = DNA
  misc_feature 12..19: note = RNA
gaggggtgcttccagcgag

SEQ ID NO: 1174 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5..6: note = DNA
  misc_feature 7: note = RNA
  misc_feature 8..9: note = DNA
  misc_feature 10..11: note = RNA
  misc_feature 12: note = DNA
  misc_feature 13..15: note = RNA
  misc_feature 16: note = DNA
  misc_feature 17..19: note = RNA
ggtattcttcctcgctgag

SEQ ID NO: 1175 - DNA, 19 bp, synthetic construct
  source 1..19: mol_type = other DNA
  misc_feature 1..3: note = RNA
  misc_feature 4: note = DNA
  misc_feature 5: note = RNA
  misc_feature 6..7: note = DNA
  misc_feature 8: note = RNA
  misc_feature 9..10: note = DNA
  misc_feature 11..12: note = RNA
  misc_feature 13: note = DNA
  misc_feature 14..16: note = RNA
  misc_feature 17: note = DNA
  misc_feature 18..19: note = RNA
cggtattcttcctcgctga

SEQ ID NO: 1176 - DNA, 19 bp, synthetic construct
  source 1..19: mol_type = other DNA
  misc_feature 1..10: note = RNA
  misc_feature 11: note = DNA
  misc_feature 12: note = RNA
  misc_feature 13..14: note = DNA
  misc_feature 15: note = RNA
  misc_feature 16..17: note = DNA
  misc_feature 18..19: note = RNA
cagagcccggtattcttcc

SEQ ID NO: 1177 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..19: note = RNA
ctcctccagcagagcccgg

SEQ ID NO: 1178 - DNA, 19 bp, synthetic construct
  source 1..19: mol_type = other DNA
  misc_feature 1: note = RNA
  misc_feature 2: note = DNA
  misc_feature 3..7: note = RNA
  misc_feature 8: note = DNA
  misc_feature 9..10: note = RNA
  misc_feature 11: note = DNA
  misc_feature 12..19: note = RNA
ctaaagctcctccagcaga

SEQ ID NO: 1179 - DNA, 19 bp, synthetic construct
  source 1..19: mol_type = other DNA
  misc_feature 1..2: note = RNA
  misc_feature 3: note = DNA
  misc_feature 4..8: note = RNA
  misc_feature 9: note = DNA
  misc_feature 10..11: note = RNA
  misc_feature 12: note = DNA
  misc_feature 13..19: note = RNA
cctaaagctcctccagcag

SEQ ID NO: 1180 - DNA, 19 bp, synthetic construct
  source 1..19: mol_type = other DNA
  misc_feature 1: note = RNA
  misc_feature 2: note = DNA
  misc_feature 3..4: note = RNA
  misc_feature 5: note = DNA
  misc_feature 6..10: note = RNA
  misc_feature 11: note = DNA
  misc_feature 12..13: note = RNA
  misc_feature 14: note = DNA
  misc_feature 15..19: note = RNA
gtcctaaagctcctccagc

SEQ ID NO: 1181 - DNA, 19 bp, synthetic construct
  source 1..19: mol_type = other DNA
  misc_feature 1..2: note = RNA
  misc_feature 3: note = DNA
  misc_feature 4..5: note = RNA
  misc_feature 6: note = DNA
  misc_feature 7..11: note = RNA
  misc_feature 12: note = DNA
  misc_feature 13..14: note = RNA
  misc_feature 15: note = DNA
  misc_feature 16..19: note = RNA
cgtcctaaagctcctccag

SEQ ID NO: 1182 - DNA, 19 bp, synthetic construct
  source 1..19: mol_type = other DNA
  misc_feature 1..6: note = RNA
  misc_feature 7: note = DNA
  misc_feature 8..9: note = RNA
  misc_feature 10: note = DNA
  misc_feature 11..15: note = RNA
  misc_feature 16: note = DNA
  misc_feature 17..18: note = RNA
  misc_feature 19: note = DNA
cccgcgtcctaaagctcct

SEQ ID NO: 1183 - DNA, 19 bp, synthetic construct
  source 1..19: mol_type = other DNA
  misc_feature 1..7: note = RNA
  misc_feature 8: note = DNA
  misc_feature 9..10: note = RNA
  misc_feature 11: note = DNA
  misc_feature 12..16: note = RNA
  misc_feature 17: note = DNA
  misc_feature 18..19: note = RNA
ccccgcgtcctaaagctcc

SEQ ID NO: 1184 - DNA, 19 bp, synthetic construct
  source 1..19: mol_type = other DNA
  misc_feature 1..8: note = RNA
  misc_feature 9: note = DNA
  misc_feature 10..11: note = RNA
  misc_feature 12: note = DNA
  misc_feature 13..17: note = RNA
  misc_feature 18: note = DNA
  misc_feature 19: note = RNA
accccgcgtcctaaagctc

SEQ ID NO: 1185 - DNA, 19 bp, synthetic construct
  source 1..19: mol_type = other DNA
  misc_feature 1..9: note = RNA
  misc_feature 10: note = DNA
  misc_feature 11..12: note = RNA
  misc_feature 13: note = DNA
  misc_feature 14..18: note = RNA
  misc_feature 19: note = DNA
aaccccgcgtcctaaagct

SEQ ID NO: 1186 - DNA, 19 bp, synthetic construct
  source 1..19: mol_type = other DNA
  misc_feature 1..10: note = RNA
  misc_feature 11: note = DNA
  misc_feature 12..13: note = RNA
  misc_feature 14: note = DNA
  misc_feature 15..19: note = RNA
caaccccgcgtcctaaagc

SEQ ID NO: 1187 - DNA, 19 bp, synthetic construct
  source 1..19: mol_type = other DNA
  misc_feature 1..11: note = RNA
  misc_feature 12: note = DNA
  misc_feature 13..14: note = RNA
  misc_feature 15: note = DNA
  misc_feature 16..19: note = RNA
ccaaccccgcgtcctaaag

SEQ ID NO: 1188 - DNA, 19 bp, synthetic construct
  source 1..19: mol_type = other DNA
  misc_feature 1..12: note = RNA
  misc_feature 13: note = DNA
  misc_feature 14..15: note = RNA
  misc_feature 16: note = DNA
  misc_feature 17..19: note = RNA
cccaaccccgcgtcctaaa

SEQ ID NO: 1189 - DNA, 19 bp, synthetic construct
  source 1..19: mol_type = other DNA
  misc_feature 1: note = DNA
  misc_feature 2..13: note = RNA
  misc_feature 14: note = DNA
  misc_feature 15..16: note = RNA
  misc_feature 17: note = DNA
  misc_feature 18..19: note = RNA
tcccaaccccgcgtcctaa

SEQ ID NO: 1190 - DNA, 19 bp, synthetic construct
  source 1..19: mol_type = other DNA
  misc_feature 1..2: note = RNA
  misc_feature 3: note = DNA
  misc_feature 4..15: note = RNA
  misc_feature 16: note = DNA
  misc_feature 17..18: note = RNA
  misc_feature 19: note = DNA
cgtcccaaccccgcgtcct

SEQ ID NO: 1191 - DNA, 19 bp, synthetic construct
  source 1..19: mol_type = other DNA
  misc_feature 1..7: note = RNA
  misc_feature 8: note = DNA
  misc_feature 9..19: note = RNA
gaccccgtcccaaccccgc

SEQ ID NO: 1192 - DNA, 19 bp, synthetic construct
  source 1..19: mol_type = other DNA
  misc_feature 1..12: note = RNA
  misc_feature 13: note = DNA
  misc_feature 14..19: note = RNA
cacccgaccccgtcccaac

SEQ ID NO: 1193 - DNA, 19 bp, synthetic construct
  source 1..19: mol_type = other DNA
  misc_feature 1..16: note = RNA
  misc_feature 17: note = DNA
  misc_feature 18..19: note = RNA
gaaccacccgaccccgtcc

SEQ ID NO: 1194 - DNA, 19 bp, synthetic construct
  source 1..19: mol_type = other DNA
  misc_feature 1..2: note = RNA
  misc_feature 3: note = DNA
  misc_feature 4..13: note = RNA
  misc_feature 14: note = DNA
  misc_feature 15..19: note = RNA
aatcccaggccggtcagcc

SEQ ID NO: 1195 - DNA, 19 bp, synthetic construct
  source 1..19: mol_type = other DNA
  misc_feature 1..3: note = RNA
  misc_feature 4: note = DNA
  misc_feature 5..14: note = RNA
  misc_feature 15: note = DNA
  misc_feature 16..19: note = RNA
gaatcccaggccggtcagc

SEQ ID NO: 1196 - DNA, 19 bp, synthetic construct
  source 1..19: mol_type = other DNA
  misc_feature 1: note = DNA
  misc_feature 2..13: note = RNA
  misc_feature 14: note = DNA
  misc_feature 15..19: note = RNA
tagaaggcaggaatcccag

SEQ ID NO: 1197 - DNA, 19 bp, synthetic construct
  source 1..19: mol_type = other DNA
  misc_feature 1: note = RNA
  misc_feature 2: note = DNA
  misc_feature 3..14: note = RNA
  misc_feature 15: note = DNA
  misc_feature 16..19: note = RNA
ctagaaggcaggaatccca

SEQ ID NO: 1198 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5..13: note = RNA
  misc_feature 14: note = DNA
  misc_feature 15..19: note = RNA
ctctcaccgggcctagacc

SEQ ID NO: 1199 - DNA, 19 bp, synthetic construct
  source 1..19: mol_type = other DNA
  misc_feature 1: note = DNA
  misc_feature 2: note = RNA
  misc_feature 3: note = DNA
  misc_feature 4: note = RNA
  misc_feature 5: note = DNA
  misc_feature 6..14: note = RNA
  misc_feature 15: note = DNA
  misc_feature 16..19: note = RNA
tctctcaccgggcctagac

SEQ ID NO: 1200 - DNA, 19 bp, synthetic construct
  source 1..19: mol_type = other DNA
  misc_feature 1: note = RNA
  misc_feature 2: note = DNA
  misc_feature 3: note = RNA
  misc_feature 4: note = DNA
  misc_feature 5: note = RNA
  misc_feature 6: note = DNA
  misc_feature 7..15: note = RNA
  misc_feature 16: note = DNA
  misc_feature 17..19: note = RNA
gtctctcaccgggcctaga

SEQ ID NO: 1201 - DNA, 19 bp, synthetic construct
  source 1..19: mol_type = other DNA
  misc_feature 1..2: note = RNA
  misc_feature 3: note = DNA
  misc_feature 4: note = RNA
  misc_feature 5: note = DNA
  misc_feature 6: note = RNA
  misc_feature 7: note = DNA
  misc_feature 8..16: note = RNA
  misc_feature 17: note = DNA
  misc_feature 18..19: note = RNA
agtctctcaccgggcctag

SEQ ID NO: 1202 - DNA, 19 bp, synthetic construct
  source 1..19: mol_type = other DNA
  misc_feature 1: note = DNA
  misc_feature 2..5: note = RNA
  misc_feature 6: note = DNA
  misc_feature 7: note = RNA
  misc_feature 8: note = DNA
  misc_feature 9: note = RNA
  misc_feature 10: note = DNA
  misc_feature 11..19: note = RNA
tggagtctctcaccgggcc

SEQ ID NO: 1203 - DNA, 19 bp, synthetic construct
  source 1..19: mol_type = other DNA
  misc_feature 1: note = RNA
  misc_feature 2: note = DNA
  misc_feature 3..6: note = RNA
  misc_feature 7: note = DNA
  misc_feature 8: note = RNA
  misc_feature 9: note = DNA
  misc_feature 10: note = RNA
  misc_feature 11: note = DNA
  misc_feature 12..19: note = RNA
gtggagtctctcaccgggc

SEQ ID NO: 1204 - DNA, 19 bp, synthetic construct
  source 1..19: mol_type = other DNA
  misc_feature 1..2: note = RNA
  misc_feature 3: note = DNA
  misc_feature 4..7: note = RNA
  misc_feature 8: note = DNA
  misc_feature 9: note = RNA
  misc_feature 10: note = DNA
  misc_feature 11: note = RNA
  misc_feature 12: note = DNA
  misc_feature 13..19: note = RNA
agtggagtctctcaccggg

SEQ ID NO: 1205 - DNA, 19 bp, synthetic construct
  source 1..19: mol_type = other DNA
  misc_feature 1..6: note = RNA
  misc_feature 7: note = DNA
  misc_feature 8..14: note = RNA
  misc_feature 15: note = DNA
  misc_feature 16..19: note = RNA
acagcgtcggaaggtgggg

SEQ ID NO: 1206 - DNA, 19 bp, synthetic construct
  source 1..19: mol_type = other DNA
  misc_feature 1..7: note = RNA
  misc_feature 8: note = DNA
  misc_feature 9..15: note = RNA
  misc_feature 16: note = DNA
  misc_feature 17..19: note = RNA
gacagcgtcggaaggtggg

SEQ ID NO: 1207 - DNA, 19 bp, synthetic construct
  source 1..19: mol_type = other DNA
  misc_feature 1..2: note = RNA
  misc_feature 3: note = DNA
  misc_feature 4..11: note = RNA
  misc_feature 12: note = DNA
  misc_feature 13..19: note = RNA
cctagacagcgtcggaagg

SEQ ID NO: 1208 - DNA, 19 bp, synthetic construct
  source 1..19: mol_type = other DNA
  misc_feature 1..3: note = RNA
  misc_feature 4: note = DNA
  misc_feature 5..12: note = RNA
  misc_feature 13: note = DNA
  misc_feature 14..19: note = RNA
gcctagacagcgtcggaag

SEQ ID NO: 1209 - DNA, 19 bp, synthetic construct
  source 1..19: mol_type = other DNA
  misc_feature 1: note = DNA
  misc_feature 2..4: note = RNA
  misc_feature 5: note = DNA
  misc_feature 6..13: note = RNA
  misc_feature 14: note = DNA
  misc_feature 15..19: note = RNA
tgcctagacagcgtcggaa

SEQ ID NO: 1210 - DNA, 19 bp, synthetic construct
  source 1..19: mol_type = other DNA
  misc_feature 1..2: note = DNA
  misc_feature 3..5: note = RNA
  misc_feature 6: note = DNA
  misc_feature 7..14: note = RNA
  misc_feature 15: note = DNA
  misc_feature 16..19: note = RNA
ttgcctagacagcgtcgga

SEQ ID NO: 1211 - DNA, 19 bp, synthetic construct
  source 1..19: mol_type = other DNA
  misc_feature 1..3: note = DNA
  misc_feature 4..6: note = RNA
  misc_feature 7: note = DNA
  misc_feature 8..15: note = RNA
  misc_feature 16: note = DNA
  misc_feature 17..19: note = RNA
tttgcctagacagcgtcgg

SEQ ID NO: 1212 - DNA, 19 bp, synthetic construct
  source 1..19: mol_type = other DNA
  misc_feature 1: note = RNA
  misc_feature 2..4: note = DNA
  misc_feature 5..7: note = RNA
  misc_feature 8: note = DNA
  misc_feature 9..16: note = RNA
  misc_feature 17: note = DNA
  misc_feature 18..19: note = RNA
gtttgcctagacagcgtcg

SEQ ID NO: 1213 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
atggccctcccgacaccca

SEQ ID NO: 1214 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tggccctcccgacacccta

SEQ ID NO: 1215 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cgacaccctcggacagcaa

SEQ ID NO: 1216 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gacaccctcggacagcaca

SEQ ID NO: 1217 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
acaccctcggacagcacca

SEQ ID NO: 1218 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
caccctcggacagcaccca

SEQ ID NO: 1219 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
accctcggacagcacccta

SEQ ID NO: 1220 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccctcggacagcaccctca

SEQ ID NO: 1221 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cctcggacagcaccctcca

SEQ ID NO: 1222 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctcggacagcaccctccca

SEQ ID NO: 1223 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcggacagcaccctcccca

SEQ ID NO: 1224 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
acagcaccctccccgcgga

SEQ ID NO: 1225 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cagcaccctccccgcggaa

SEQ ID NO: 1226 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
agcaccctccccgcggaaa

SEQ ID NO: 1227 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggaagcccggggacgagga

SEQ ID NO: 1228 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gaagcccggggacgaggaa

SEQ ID NO: 1229 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aagcccggggacgaggaca

SEQ ID NO: 1230 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggacgaggacggcgacgga

SEQ ID NO: 1231 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gacgaggacggcgacggaa

SEQ ID NO: 1232 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
acgaggacggcgacggaga

SEQ ID NO: 1233 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cgaggacggcgacggagaa

SEQ ID NO: 1234 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gaggacggcgacggagaca

SEQ ID NO: 1235 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
aggacggcgacggagacta

SEQ ID NO: 1236 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggacggcgacggagactca

SEQ ID NO: 1237 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gacggcgacggagactcga

SEQ ID NO: 1238 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
acggcgacggagactcgta

SEQ ID NO: 1239 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcgacggagactcgtttga

SEQ ID NO: 1240 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgacggagactcgtttgga

SEQ ID NO: 1241 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gacggagactcgtttggaa

SEQ ID NO: 1242 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
acggagactcgtttggaca

SEQ ID NO: 1243 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cggagactcgtttggacca

SEQ ID NO: 1244 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggagactcgtttggaccca

SEQ ID NO: 1245 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gagactcgtttggacccca

SEQ ID NO: 1246 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agactcgtttggaccccga

SEQ ID NO: 1247 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcgtttggaccccgagcca

SEQ ID NO: 1248 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tggaccccgagccaaagca

SEQ ID NO: 1249 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggaccccgagccaaagcga

SEQ ID NO: 1250 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gaccccgagccaaagcgaa

SEQ ID NO: 1251 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
accccgagccaaagcgaga

SEQ ID NO: 1252 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccccgagccaaagcgagga

SEQ ID NO: 1253 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cccgagccaaagcgaggca

SEQ ID NO: 1254 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccgagccaaagcgaggcca

SEQ ID NO: 1255 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgagccaaagcgaggccca

SEQ ID NO: 1256 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gagccaaagcgaggcccta

SEQ ID NO: 1257 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agccaaagcgaggccctga

SEQ ID NO: 1258 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gccaaagcgaggccctgca

SEQ ID NO: 1259 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccaaagcgaggccctgcga

SEQ ID NO: 1260 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
caaagcgaggccctgcgaa

SEQ ID NO: 1261 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aaagcgaggccctgcgaga

SEQ ID NO: 1262 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aagcgaggccctgcgagca

SEQ ID NO: 1263 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctgctttgagcggaaccca

SEQ ID NO: 1264 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tgctttgagcggaacccga

SEQ ID NO: 1265 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gctttgagcggaacccgta

SEQ ID NO: 1266 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ctttgagcggaacccgtaa

SEQ ID NO: 1267 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tttgagcggaacccgtaca

SEQ ID NO: 1268 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ttgagcggaacccgtacca

SEQ ID NO: 1269 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tgagcggaacccgtaccca

SEQ ID NO: 1270 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gagcggaacccgtacccga

SEQ ID NO: 1271 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agcggaacccgtacccgga

SEQ ID NO: 1272 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccgtacccgggcatcgcca

SEQ ID NO: 1273 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cgtacccgggcatcgccaa

SEQ ID NO: 1274 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gtacccgggcatcgccaca

SEQ ID NO: 1275 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tacccgggcatcgccacca

SEQ ID NO: 1276 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cccgggcatcgccaccaga

SEQ ID NO: 1277 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccgggcatcgccaccagaa

SEQ ID NO: 1278 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgggcatcgccaccagaga

SEQ ID NO: 1279 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gggcatcgccaccagagaa

SEQ ID NO: 1280 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggcatcgccaccagagaaa

SEQ ID NO: 1281 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcatcgccaccagagaaca

SEQ ID NO: 1282 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
catcgccaccagagaacga

SEQ ID NO: 1283 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
atcgccaccagagaacgga

SEQ ID NO: 1284 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcgccaccagagaacggca

SEQ ID NO: 1285 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cgccaccagagaacggcta

SEQ ID NO: 1286 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cagagaacggctggcccaa

SEQ ID NO: 1287 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agagaacggctggcccaga

SEQ ID NO: 1288 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gagaacggctggcccagga

SEQ ID NO: 1289 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
agaacggctggcccaggca

SEQ ID NO: 1290 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gaacggctggcccaggcca

SEQ ID NO: 1291 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcccaggccatcggcatta

SEQ ID NO: 1292 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cccaggccatcggcattca

SEQ ID NO: 1293 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccaggccatcggcattcca

SEQ ID NO: 1294 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
caggccatcggcattccga

SEQ ID NO: 1295 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aggccatcggcattccgga

SEQ ID NO: 1296 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggccatcggcattccggaa

SEQ ID NO: 1297 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gccatcggcattccggaga

SEQ ID NO: 1298 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccatcggcattccggagca

SEQ ID NO: 1299 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
catcggcattccggagcca

SEQ ID NO: 1300 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
atcggcattccggagccca

SEQ ID NO: 1301 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tcggcattccggagcccaa

SEQ ID NO: 1302 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cggcattccggagcccaga

SEQ ID NO: 1303 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggcattccggagcccagga

SEQ ID NO: 1304 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcattccggagcccaggga

SEQ ID NO: 1305 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cattccggagcccagggta

SEQ ID NO: 1306 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
attccggagcccagggtca

SEQ ID NO: 1307 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ttccggagcccagggtcca

SEQ ID NO: 1308 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tccggagcccagggtccaa

SEQ ID NO: 1309 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccggagcccagggtccaga

SEQ ID NO: 1310 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cggagcccagggtccagaa

SEQ ID NO: 1311 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggagcccagggtccagata

SEQ ID NO: 1312 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggtccagatttggtttcaa

SEQ ID NO: 1313 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gtccagatttggtttcaga

SEQ ID NO: 1314 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tccagatttggtttcagaa

SEQ ID NO: 1315 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccagatttggtttcagaaa

SEQ ID NO: 1316 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cagatttggtttcagaata

SEQ ID NO: 1317 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gatttggtttcagaatgaa

SEQ ID NO: 1318 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tttggtttcagaatgagaa

SEQ ID NO: 1319 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ttggtttcagaatgagaga

SEQ ID NO: 1320 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tggtttcagaatgagagga

SEQ ID NO: 1321 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggtttcagaatgagaggta

SEQ ID NO: 1322 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gtttcagaatgagaggtca

SEQ ID NO: 1323 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tttcagaatgagaggtcaa

SEQ ID NO: 1324 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ttcagaatgagaggtcaca

SEQ ID NO: 1325 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tcagaatgagaggtcacga

SEQ ID NO: 1326 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cagaatgagaggtcacgca

SEQ ID NO: 1327 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
agaatgagaggtcacgcca

SEQ ID NO: 1328 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gaatgagaggtcacgccaa

SEQ ID NO: 1329 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aatgagaggtcacgccaga

SEQ ID NO: 1330 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
atgagaggtcacgccagca

SEQ ID NO: 1331 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tgagaggtcacgccagcta

SEQ ID NO: 1332 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gagaggtcacgccagctga

SEQ ID NO: 1333 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
agaggtcacgccagctgaa

SEQ ID NO: 1334 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gaggtcacgccagctgaga

SEQ ID NO: 1335 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aggtcacgccagctgagga

SEQ ID NO: 1336 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggtcacgccagctgaggca

SEQ ID NO: 1337 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gtcacgccagctgaggcaa

SEQ ID NO: 1338 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tcacgccagctgaggcaga

SEQ ID NO: 1339 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cacgccagctgaggcagca

SEQ ID NO: 1340 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tgaggcagcaccggcggga

SEQ ID NO: 1341 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gaggcagcaccggcgggaa

SEQ ID NO: 1342 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
aggcagcaccggcgggaaa

SEQ ID NO: 1343 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggcagcaccggcgggaata

SEQ ID NO: 1344 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcagcaccggcgggaatca

SEQ ID NO: 1345 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cagcaccggcgggaatcta

SEQ ID NO: 1346 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
agcaccggcgggaatctca

SEQ ID NO: 1347 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcaccggcgggaatctcga

SEQ ID NO: 1348 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
caccggcgggaatctcgga

SEQ ID NO: 1349 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cggcgggaatctcggccca

SEQ ID NO: 1350 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggcgggaatctcggcccta

SEQ ID NO: 1351 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcgggaatctcggccctga

SEQ ID NO: 1352 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgggaatctcggccctgga

SEQ ID NO: 1353 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gggaatctcggccctggca

SEQ ID NO: 1354 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggaatctcggccctggcca

SEQ ID NO: 1355 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gaatctcggccctggccca

SEQ ID NO: 1356 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gagacgcggcccgccagaa

SEQ ID NO: 1357 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
agacgcggcccgccagaaa

SEQ ID NO: 1358 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gccagaaggccggcgaaaa

SEQ ID NO: 1359 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccagaaggccggcgaaaga

SEQ ID NO: 1360 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cagaaggccggcgaaagca

SEQ ID NO: 1361 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agaaggccggcgaaagcga

SEQ ID NO: 1362 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gaaggccggcgaaagcgga

SEQ ID NO: 1363 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
aaggccggcgaaagcggaa

SEQ ID NO: 1364 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcgaaagcggaccgccgta

SEQ ID NO: 1365 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgaaagcggaccgccgtca

SEQ ID NO: 1366 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gaaagcggaccgccgtcaa

SEQ ID NO: 1367 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aaagcggaccgccgtcaca

SEQ ID NO: 1368 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aagcggaccgccgtcacca

SEQ ID NO: 1369 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cggaccgccgtcaccggaa

SEQ ID NO: 1370 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggaccgccgtcaccggata

SEQ ID NO: 1371 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gaccgccgtcaccggatca

SEQ ID NO: 1372 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
accgccgtcaccggatcca

SEQ ID NO: 1373 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccgccgtcaccggatccca

SEQ ID NO: 1374 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cgccgtcaccggatcccaa

SEQ ID NO: 1375 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gccgtcaccggatcccaga

SEQ ID NO: 1376 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccgtcaccggatcccagaa

SEQ ID NO: 1377 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgtcaccggatcccagaca

SEQ ID NO: 1378 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gtcaccggatcccagacca

SEQ ID NO: 1379 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tcaccggatcccagaccga

SEQ ID NO: 1380 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
caccggatcccagaccgca

SEQ ID NO: 1381 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
accggatcccagaccgcca

SEQ ID NO: 1382 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccggatcccagaccgccca

SEQ ID NO: 1383 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cggatcccagaccgcccta

SEQ ID NO: 1384 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggatcccagaccgccctga

SEQ ID NO: 1385 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gatcccagaccgccctgca

SEQ ID NO: 1386 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
atcccagaccgccctgcta

SEQ ID NO: 1387 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcccagaccgccctgctca

SEQ ID NO: 1388 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cccagaccgccctgctcca

SEQ ID NO: 1389 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ccagaccgccctgctccta

SEQ ID NO: 1390 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cagaccgccctgctcctca

SEQ ID NO: 1391 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
agaccgccctgctcctcca

SEQ ID NO: 1392 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gaccgccctgctcctccga

SEQ ID NO: 1393 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
accgccctgctcctccgaa

SEQ ID NO: 1394 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctcctccgagcctttgaga

SEQ ID NO: 1395 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctccgagcctttgagaaga

SEQ ID NO: 1396 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctttgagaaggatcgctta

SEQ ID NO: 1397 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tttgagaaggatcgcttta

SEQ ID NO: 1398 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ttgagaaggatcgctttca

SEQ ID NO: 1399 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tgagaaggatcgctttcca

SEQ ID NO: 1400 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gagaaggatcgctttccaa

SEQ ID NO: 1401 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agaaggatcgctttccaga

SEQ ID NO: 1402 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gaaggatcgctttccagga

SEQ ID NO: 1403 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aaggatcgctttccaggca

SEQ ID NO: 1404 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
aggatcgctttccaggcaa

SEQ ID NO: 1405 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggatcgctttccaggcata

SEQ ID NO: 1406 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gatcgctttccaggcatca

SEQ ID NO: 1407 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
atcgctttccaggcatcga

SEQ ID NO: 1408 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcgctttccaggcatcgca

SEQ ID NO: 1409 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgctttccaggcatcgcca

SEQ ID NO: 1410 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gctttccaggcatcgccga

SEQ ID NO: 1411 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctttccaggcatcgccgca

SEQ ID NO: 1412 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tttccaggcatcgccgcca

SEQ ID NO: 1413 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ttccaggcatcgccgccca

SEQ ID NO: 1414 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccgggaggagctggccaga

SEQ ID NO: 1415 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cgggaggagctggccagaa

SEQ ID NO: 1416 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gggaggagctggccagaga

SEQ ID NO: 1417 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggaggagctggccagagaa

SEQ ID NO: 1418 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gaggagctggccagagaga

SEQ ID NO: 1419 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
aggagctggccagagagaa

SEQ ID NO: 1420 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggagctggccagagagaca

SEQ ID NO: 1421 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gagctggccagagagacga

SEQ ID NO: 1422 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agctggccagagagacgga

SEQ ID NO: 1423 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gctggccagagagacggga

SEQ ID NO: 1424 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gccagagagacgggcctca

SEQ ID NO: 1425 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccagagagacgggcctcca

SEQ ID NO: 1426 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cagagagacgggcctccca

SEQ ID NO: 1427 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agagagacgggcctcccga

SEQ ID NO: 1428 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggcctcccggagtccagga

SEQ ID NO: 1429 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gcctcccggagtccaggaa

SEQ ID NO: 1430 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cctcccggagtccaggata

SEQ ID NO: 1431 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctcccggagtccaggatta

SEQ ID NO: 1432 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcccggagtccaggattca

SEQ ID NO: 1433 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cccggagtccaggattcaa

SEQ ID NO: 1434 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccggagtccaggattcaga

SEQ ID NO: 1435 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cggagtccaggattcagaa

SEQ ID NO: 1436 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggagtccaggattcagata

SEQ ID NO: 1437 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gagtccaggattcagatca

SEQ ID NO: 1438 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
agtccaggattcagatcta

SEQ ID NO: 1439 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
caggattcagatctggtta

SEQ ID NO: 1440 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
aggattcagatctggttta

SEQ ID NO: 1441 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggattcagatctggtttca

SEQ ID NO: 1442 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gattcagatctggtttcaa

SEQ ID NO: 1443 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
attcagatctggtttcaga

SEQ ID NO: 1444 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctggtttcagaatcgaaga

SEQ ID NO: 1445 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tggtttcagaatcgaagga

SEQ ID NO: 1446 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggtttcagaatcgaaggga

SEQ ID NO: 1447 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gtttcagaatcgaagggca

SEQ ID NO: 1448 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tttcagaatcgaagggcca

SEQ ID NO: 1449 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ttcagaatcgaagggccaa

SEQ ID NO: 1450 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tcagaatcgaagggccaga

SEQ ID NO: 1451 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cagaatcgaagggccagga

SEQ ID NO: 1452 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
agaatcgaagggccaggca

SEQ ID NO: 1453 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gaatcgaagggccaggcaa

SEQ ID NO: 1454 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aatcgaagggccaggcaca

SEQ ID NO: 1455 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
atcgaagggccaggcacca

SEQ ID NO: 1456 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcgaagggccaggcaccca

SEQ ID NO: 1457 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggggtcaccctgctcccta

SEQ ID NO: 1458 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gggtcaccctgctccctca

SEQ ID NO: 1459 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggtcaccctgctccctcga

SEQ ID NO: 1460 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gtcaccctgctccctcgta

SEQ ID NO: 1461 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tcaccctgctccctcgtga

SEQ ID NO: 1462 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
caccctgctccctcgtgga

SEQ ID NO: 1463 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ccctgctccctcgtgggta

SEQ ID NO: 1464 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cctgctccctcgtgggtca

SEQ ID NO: 1465 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctgctccctcgtgggtcga

SEQ ID NO: 1466 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tgctccctcgtgggtcgca

SEQ ID NO: 1467 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gctccctcgtgggtcgcca

SEQ ID NO: 1468 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctccctcgtgggtcgccta

SEQ ID NO: 1469 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tccctcgtgggtcgcctta

SEQ ID NO: 1470 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccctcgtgggtcgccttca

SEQ ID NO: 1471 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctcgtgggtcgccttcga

SEQ ID NO: 1472 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctcgtgggtcgccttcgca

SEQ ID NO: 1473 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcgtgggtcgccttcgcca

SEQ ID NO: 1474 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gggtcgccttcgcccacaa

SEQ ID NO: 1475 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggtcgccttcgcccacaca

SEQ ID NO: 1476 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gtcgccttcgcccacacca

SEQ ID NO: 1477 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tcgccttcgcccacaccga

SEQ ID NO: 1478 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cacaccggcgcgtggggaa

SEQ ID NO: 1479 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
acaccggcgcgtggggaaa

SEQ ID NO: 1480 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cgcgtggggaacggggcta

SEQ ID NO: 1481 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcgtggggaacggggctta

SEQ ID NO: 1482 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggcttcccgcaccccacga

SEQ ID NO: 1483 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcttcccgcaccccacgta

SEQ ID NO: 1484 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ttcgtgagccaggcagcga

SEQ ID NO: 1485 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tcgtgagccaggcagcgaa

SEQ ID NO: 1486 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgtgagccaggcagcgaga

SEQ ID NO: 1487 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gtgagccaggcagcgagga

SEQ ID NO: 1488 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cgccggcagaggggatcta

SEQ ID NO: 1489 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gccggcagaggggatctca

SEQ ID NO: 1490 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccggcagaggggatctcca

SEQ ID NO: 1491 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cggcagaggggatctccca

SEQ ID NO: 1492 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggcagaggggatctcccaa

SEQ ID NO: 1493 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggatctcccaacctgccca

SEQ ID NO: 1494 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gatctcccaacctgcccca

SEQ ID NO: 1495 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
atctcccaacctgccccga

SEQ ID NO: 1496 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tctcccaacctgccccgga

SEQ ID NO: 1497 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgcggggatttcgcctaca

SEQ ID NO: 1498 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcggggatttcgcctacga

SEQ ID NO: 1499 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cggggatttcgcctacgca

SEQ ID NO: 1500 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggggatttcgcctacgcca

SEQ ID NO: 1501 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gggatttcgcctacgccga

SEQ ID NO: 1502 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggatttcgcctacgccgca

SEQ ID NO: 1503 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gatttcgcctacgccgcca

SEQ ID NO: 1504 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
atttcgcctacgccgccca

SEQ ID NO: 1505 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tttcgcctacgccgcccca

SEQ ID NO: 1506 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gggcgctctcccaccctca

SEQ ID NO: 1507 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggcgctctcccaccctcaa

SEQ ID NO: 1508 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcgctctcccaccctcaga

SEQ ID NO: 1509 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgctctcccaccctcagga

SEQ ID NO: 1510 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gctctcccaccctcaggca

SEQ ID NO: 1511 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctctcccaccctcaggcta

SEQ ID NO: 1512 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tctcccaccctcaggctca

SEQ ID NO: 1513 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctcccaccctcaggctcca

SEQ ID NO: 1514 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tcccaccctcaggctccta

SEQ ID NO: 1515 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cccaccctcaggctcctca

SEQ ID NO: 1516 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccaccctcaggctcctcga

SEQ ID NO: 1517 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
caccctcaggctcctcgga

SEQ ID NO: 1518 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
accctcaggctcctcggta

SEQ ID NO: 1519 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccctcaggctcctcggtga

SEQ ID NO: 1520 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctcaggctcctcggtgga

SEQ ID NO: 1521 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctcaggctcctcggtggca

SEQ ID NO: 1522 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctcctcggtggcctccgca

SEQ ID NO: 1523 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tcctcggtggcctccgcaa

SEQ ID NO: 1524 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gcctccgcacccgggcaaa

SEQ ID NO: 1525 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cctccgcacccgggcaaaa

SEQ ID NO: 1526 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ctccgcacccgggcaaaaa

SEQ ID NO: 1527 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tccgcacccgggcaaaaga

SEQ ID NO: 1528 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccgcacccgggcaaaagca

SEQ ID NO: 1529 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgcacccgggcaaaagcca

SEQ ID NO: 1530 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgggcaaaagccgggagga

SEQ ID NO: 1531 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gggcaaaagccgggaggaa

SEQ ID NO: 1532 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggcaaaagccgggaggaca

SEQ ID NO: 1533 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcaaaagccgggaggacca

SEQ ID NO: 1534 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctgcgcggtggcacagcca

SEQ ID NO: 1535 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tgcgcggtggcacagccta

SEQ ID NO: 1536 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cacagcctgggcccgctca

SEQ ID NO: 1537 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
acagcctgggcccgctcaa

SEQ ID NO: 1538 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cagcctgggcccgctcaaa

SEQ ID NO: 1539 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agcctgggcccgctcaaga

SEQ ID NO: 1540 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgcagggccaaggggtgca

SEQ ID NO: 1541 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcagggccaaggggtgcta

SEQ ID NO: 1542 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccacccacgtcccagggga

SEQ ID NO: 1543 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cacccacgtcccaggggaa

SEQ ID NO: 1544 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
acccacgtcccaggggaga

SEQ ID NO: 1545 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cccaggggagtccgtggta

SEQ ID NO: 1546 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccaggggagtccgtggtga

SEQ ID NO: 1547 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
caggggagtccgtggtgga

SEQ ID NO: 1548 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aggggagtccgtggtggga

SEQ ID NO: 1549 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggcggcgtgggaaccccaa

SEQ ID NO: 1550 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccaagccggggcagctcca

SEQ ID NO: 1551 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
caagccggggcagctccaa

SEQ ID NO: 1552 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aagccggggcagctccaca

SEQ ID NO: 1553 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gggcagctccacctcccca

SEQ ID NO: 1554 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggcagctccacctccccaa

SEQ ID NO: 1555 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcagctccacctccccaga

SEQ ID NO: 1556 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cagctccacctccccagca

SEQ ID NO: 1557 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgcggcaggggcagatgca

SEQ ID NO: 1558 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cggcaggggcagatgcaaa

SEQ ID NO: 1559 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggcaggggcagatgcaaga

SEQ ID NO: 1560 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcaggggcagatgcaagga

SEQ ID NO: 1561 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
caggggcagatgcaaggca

SEQ ID NO: 1562 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
aggggcagatgcaaggcaa

SEQ ID NO: 1563 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tgcaaggcatcccggcgca

SEQ ID NO: 1564 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
caaggcatcccggcgccca

SEQ ID NO: 1565 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
aaggcatcccggcgcccta

SEQ ID NO: 1566 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctcccaggcgctccagga

SEQ ID NO: 1567 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggcgccctggtctgcacta

SEQ ID NO: 1568 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcgccctggtctgcactca

SEQ ID NO: 1569 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgccctggtctgcactcca

SEQ ID NO: 1570 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gccctggtctgcactccca

SEQ ID NO: 1571 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccctggtctgcactcccca

SEQ ID NO: 1572 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cctggtctgcactccccta

SEQ ID NO: 1573 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctggtctgcactcccctga

SEQ ID NO: 1574 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tggtctgcactcccctgca

SEQ ID NO: 1575 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggtctgcactcccctgcga

SEQ ID NO: 1576 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gtctgcactcccctgcgga

SEQ ID NO: 1577 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tctgcactcccctgcggca

SEQ ID NO: 1578 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctgcactcccctgcggcca

SEQ ID NO: 1579 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tgcactcccctgcggccta

SEQ ID NO: 1580 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cactcccctgcggcctgca

SEQ ID NO: 1581 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
actcccctgcggcctgcta

SEQ ID NO: 1582 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcccctgcggcctgctgca

SEQ ID NO: 1583 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctgcggcctgctgctgga

SEQ ID NO: 1584 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ctgcggcctgctgctggaa

SEQ ID NO: 1585 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tgcggcctgctgctggata

SEQ ID NO: 1586 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcggcctgctgctggatga

SEQ ID NO: 1587 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cggcctgctgctggatgaa

SEQ ID NO: 1588 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggcctgctgctggatgaga

SEQ ID NO: 1589 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcctgctgctggatgagca

SEQ ID NO: 1590 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cctgctgctggatgagcta

SEQ ID NO: 1591 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctgctgctggatgagctca

SEQ ID NO: 1592 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tgctgctggatgagctcca

SEQ ID NO: 1593 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gctgctggatgagctccta

SEQ ID NO: 1594 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctgctggatgagctcctga

SEQ ID NO: 1595 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tgctggatgagctcctgga

SEQ ID NO: 1596 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gctggatgagctcctggca

SEQ ID NO: 1597 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tcctggcgagcccggagta

SEQ ID NO: 1598 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cctggcgagcccggagtta

SEQ ID NO: 1599 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctggcgagcccggagttta

SEQ ID NO: 1600 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gagcccggagtttctgcaa

SEQ ID NO: 1601 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agcccggagtttctgcaga

SEQ ID NO: 1602 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcccggagtttctgcagca

SEQ ID NO: 1603 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cccggagtttctgcagcaa

SEQ ID NO: 1604 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccggagtttctgcagcaga

SEQ ID NO: 1605 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cggagtttctgcagcagga

SEQ ID NO: 1606 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggagtttctgcagcaggca

SEQ ID NO: 1607 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gagtttctgcagcaggcga

SEQ ID NO: 1608 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
agtttctgcagcaggcgca

SEQ ID NO: 1609 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gtttctgcagcaggcgcaa

SEQ ID NO: 1610 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tttctgcagcaggcgcaaa

SEQ ID NO: 1611 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ttctgcagcaggcgcaaca

SEQ ID NO: 1612 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tctgcagcaggcgcaacca

SEQ ID NO: 1613 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctgcagcaggcgcaaccta

SEQ ID NO: 1614 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tgcagcaggcgcaacctca

SEQ ID NO: 1615 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcagcaggcgcaacctcta

SEQ ID NO: 1616 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cagcaggcgcaacctctca

SEQ ID NO: 1617 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
agcaggcgcaacctctcca

SEQ ID NO: 1618 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcaggcgcaacctctccta

SEQ ID NO: 1619 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
caggcgcaacctctcctaa

SEQ ID NO: 1620 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aggcgcaacctctcctaga

SEQ ID NO: 1621 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggcgcaacctctcctagaa

SEQ ID NO: 1622 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gcgcaacctctcctagaaa

SEQ ID NO: 1623 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cgcaacctctcctagaaaa

SEQ ID NO: 1624 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcaacctctcctagaaaca

SEQ ID NO: 1625 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
caacctctcctagaaacga

SEQ ID NO: 1626 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aacctctcctagaaacgga

SEQ ID NO: 1627 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcctagaaacggaggccca

SEQ ID NO: 1628 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cctagaaacggaggcccca

SEQ ID NO: 1629 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctagaaacggaggccccga

SEQ ID NO: 1630 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ccggtgagagactccacta

SEQ ID NO: 1631 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cggtgagagactccactca

SEQ ID NO: 1632 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggtgagagactccactcca

SEQ ID NO: 1633 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cccttgttcttccgtgaaa

SEQ ID NO: 1634 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccttgttcttccgtgaaaa

SEQ ID NO: 1635 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cttgttcttccgtgaaata

SEQ ID NO: 1636 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ttgttcttccgtgaaatta

SEQ ID NO: 1637 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tgttcttccgtgaaattca

SEQ ID NO: 1638 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gttcttccgtgaaattcta

SEQ ID NO: 1639 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ttcttccgtgaaattctga

SEQ ID NO: 1640 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tcttccgtgaaattctgga

SEQ ID NO: 1641 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cttccgtgaaattctggca

SEQ ID NO: 1642 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ttctggctgaatgtctcca

SEQ ID NO: 1643 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tctggctgaatgtctccca

SEQ ID NO: 1644 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gacgctgtctaggcaaaca

SEQ ID NO: 1645 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
acgctgtctaggcaaacca

SEQ ID NO: 1646 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cgctgtctaggcaaaccta

SEQ ID NO: 1647 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gctgtctaggcaaacctga

SEQ ID NO: 1648 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctgtctaggcaaacctgga

SEQ ID NO: 1649 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tgtctaggcaaacctggaa

SEQ ID NO: 1650 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gtctaggcaaacctggata

SEQ ID NO: 1651 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tctaggcaaacctggatta

SEQ ID NO: 1652 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ctaggcaaacctggattaa

SEQ ID NO: 1653 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
taggcaaacctggattaga

SEQ ID NO: 1654 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
aggcaaacctggattagaa

SEQ ID NO: 1655 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggcaaacctggattagaga

SEQ ID NO: 1656 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcaaacctggattagagta

SEQ ID NO: 1657 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
caaacctggattagagtta

SEQ ID NO: 1658 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
aaacctggattagagttaa

SEQ ID NO: 1659 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aacctggattagagttaca

SEQ ID NO: 1660 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
acctggattagagttacaa

SEQ ID NO: 1661 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cctggattagagttacata

SEQ ID NO: 1662 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctggattagagttacatca

SEQ ID NO: 1663 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tggattagagttacatcta

SEQ ID NO: 1664 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggattagagttacatctca

SEQ ID NO: 1665 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gattagagttacatctcca

SEQ ID NO: 1666 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
attagagttacatctccta

SEQ ID NO: 1667 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ttagagttacatctcctga

SEQ ID NO: 1668 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tagagttacatctcctgga

SEQ ID NO: 1669 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
agagttacatctcctggaa

SEQ ID NO: 1670 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
atctcctggatgattagta

SEQ ID NO: 1671 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tctcctggatgattagtta

SEQ ID NO: 1672 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctcctggatgattagttca

SEQ ID NO: 1673 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tcctggatgattagttcaa

SEQ ID NO: 1674 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctggatgattagttcaga

SEQ ID NO: 1675 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ctggatgattagttcagaa

SEQ ID NO: 1676 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcaccctccccgcggaaga

SEQ ID NO: 1677 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
caccctccccgcggaagca

SEQ ID NO: 1678 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
accctccccgcggaagcca

SEQ ID NO: 1679 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctccccgcggaagcccga

SEQ ID NO: 1680 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccgcggaagcccggggaca

SEQ ID NO: 1681 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gcggaagcccggggacgaa

SEQ ID NO: 1682 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cggaagcccggggacgaga

SEQ ID NO: 1683 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
atttggtttcagaatgaga

SEQ ID NO: 1684 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
accggcgggaatctcggca

SEQ ID NO: 1685 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccctggcccgggagacgca

SEQ ID NO: 1686 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctggcccgggagacgcga

SEQ ID NO: 1687 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctggcccgggagacgcgga

SEQ ID NO: 1688 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gacgcggcccgccagaaga

SEQ ID NO: 1689 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
acgcggcccgccagaagga

SEQ ID NO: 1690 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aggccggcgaaagcggaca

SEQ ID NO: 1691 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggccggcgaaagcggacca

SEQ ID NO: 1692 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gccggcgaaagcggaccga

SEQ ID NO: 1693 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccgccctgctcctccgaga

SEQ ID NO: 1694 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccaggcatcgccgcccgga

SEQ ID NO: 1695 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcatcgccgcccgggagga

SEQ ID NO: 1696 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
catcgccgcccgggaggaa

SEQ ID NO: 1697 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
atcgccgcccgggaggaga

SEQ ID NO: 1698 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcgccgcccgggaggagca

SEQ ID NO: 1699 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cgccgcccgggaggagcta

SEQ ID NO: 1700 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gggccaggcacccgggaca

SEQ ID NO: 1701 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gacagggtggcagggcgca

SEQ ID NO: 1702 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
acagggtggcagggcgcca

SEQ ID NO: 1703 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agggtggcagggcgcccga

SEQ ID NO: 1704 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gggtggcagggcgcccgca

SEQ ID NO: 1705 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gtggcagggcgcccgcgca

SEQ ID NO: 1706 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aggcggcctgtgcagcgca

SEQ ID NO: 1707 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggcggcctgtgcagcgcga

SEQ ID NO: 1708 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcggcctgtgcagcgcgga

SEQ ID NO: 1709 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgccttcgcccacaccgga

SEQ ID NO: 1710 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
caccggcgcgtggggaaca

SEQ ID NO: 1711 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
accggcgcgtggggaacga

SEQ ID NO: 1712 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccggcgcgtggggaacgga

SEQ ID NO: 1713 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cggcgcgtggggaacggga

SEQ ID NO: 1714 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcgcgtggggaacggggca

SEQ ID NO: 1715 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gggcttcccgcaccccaca

SEQ ID NO: 1716 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
caccccacgtgccctgcga

SEQ ID NO: 1717 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccccacgtgccctgcgcga

SEQ ID NO: 1718 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccacgtgccctgcgcgcca

SEQ ID NO: 1719 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
acgtgccctgcgcgcctga

SEQ ID NO: 1720 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctgcgcgcctggggctcta

SEQ ID NO: 1721 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gctttcgtgagccaggcaa

SEQ ID NO: 1722 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctttcgtgagccaggcaga

SEQ ID NO: 1723 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tttcgtgagccaggcagca

SEQ ID NO: 1724 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccaggcagcgagggccgca

SEQ ID NO: 1725 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctgcagcccagccaggcca

SEQ ID NO: 1726 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcagcccagccaggccgca

SEQ ID NO: 1727 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccagccaggccgcgccgga

SEQ ID NO: 1728 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccgcgccggcagaggggaa

SEQ ID NO: 1729 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccaacctgccccggcgcga

SEQ ID NO: 1730 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aacctgccccggcgcgcga

SEQ ID NO: 1731 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gcgcggggatttcgcctaa

SEQ ID NO: 1732 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ttcgcctacgccgccccga

SEQ ID NO: 1733 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgcctacgccgccccggca

SEQ ID NO: 1734 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggctcctccggacggggca

SEQ ID NO: 1735 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gctcctccggacggggcga

SEQ ID NO: 1736 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggggcgctctcccacccta

SEQ ID NO: 1737 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gaggaccgggacccgcaga

SEQ ID NO: 1738 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gggacccgcagcgcgacga

SEQ ID NO: 1739 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cccgcagcgcgacggccta

SEQ ID NO: 1740 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcctgccgggcccctgcga

SEQ ID NO: 1741 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cctgcgcggtggcacagca

SEQ ID NO: 1742 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcgcggtggcacagcctga

SEQ ID NO: 1743 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgcggtggcacagcctgga

SEQ ID NO: 1744 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cggtggcacagcctgggca

SEQ ID NO: 1745 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcacagcctgggcccgcta

SEQ ID NO: 1746 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctgggcccgctcaagcga

SEQ ID NO: 1747 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccgcagggccaaggggtga

SEQ ID NO: 1748 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gtgcttgcgccacccacga

SEQ ID NO: 1749 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
tgcttgcgccacccacgta

SEQ ID NO: 1750 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcttgcgccacccacgtca

SEQ ID NO: 1751 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cttgcgccacccacgtcca

SEQ ID NO: 1752 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tgcgccacccacgtcccaa

SEQ ID NO: 1753 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agtccgtggtggggctgga

SEQ ID NO: 1754 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gggccggggtccccaggta

SEQ ID NO: 1755 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccggggtccccaggtcgca

SEQ ID NO: 1756 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccggggcggcgtgggaaca

SEQ ID NO: 1757 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctccacctccccagcccga

SEQ ID NO: 1758 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cacctccccagcccgcgca

SEQ ID NO: 1759 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cctccccagcccgcgccca

SEQ ID NO: 1760 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cgcctccgcgcggcaggga

SEQ ID NO: 1761 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccgcgcggcaggggcagaa

SEQ ID NO: 1762 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gcgcggcaggggcagatga

SEQ ID NO: 1763 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cccaggcgctccaggagca

SEQ ID NO: 1764 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gagccggcgccctggtcta

SEQ ID NO: 1765 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gccggcgccctggtctgca

SEQ ID NO: 1766 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccggcgccctggtctgcaa

SEQ ID NO: 1767 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cggcgccctggtctgcaca

SEQ ID NO: 1768 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctcccctgcggcctgctga

SEQ ID NO: 1769 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctggatgagctcctggcga

SEQ ID NO: 1770 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggggagctggaggcctcga

SEQ ID NO: 1771 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gagctggaggcctcggaaa

SEQ ID NO: 1772 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
agctggaggcctcggaaga

SEQ ID NO: 1773 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gctggaggcctcggaagaa

SEQ ID NO: 1774 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggccgcctcgctggaagca

SEQ ID NO: 1775 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gccgcctcgctggaagcaa

SEQ ID NO: 1776 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ccgcctcgctggaagcaca

SEQ ID NO: 1777 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cgcctcgctggaagcacca

SEQ ID NO: 1778 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
gcctcgctggaagcaccca

SEQ ID NO: 1779 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctcgctggaagcaccccta

SEQ ID NO: 1780 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-adenosine-3'-phosphate
  modified_base 16: mod_base = OTHER; note = 2'-O-methyl-uridine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctcagcgaggaagaataca

SEQ ID NO: 1781 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-adenosine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
tcagcgaggaagaatacca

SEQ ID NO: 1782 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggaagaataccgggctcta

SEQ ID NO: 1783 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccgggctctgctggaggaa

SEQ ID NO: 1784 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tctgctggaggagctttaa

SEQ ID NO: 1785 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctgctggaggagctttaga

SEQ ID NO: 1786 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gctggaggagctttaggaa

SEQ ID NO: 1787 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctggaggagctttaggaca

SEQ ID NO: 1788 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
aggagctttaggacgcgga

SEQ ID NO: 1789 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ggagctttaggacgcggga

SEQ ID NO: 1790 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gagctttaggacgcgggga

SEQ ID NO: 1791 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
agctttaggacgcggggta

SEQ ID NO: 1792 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-uridine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gctttaggacgcggggtta

SEQ ID NO: 1793 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ctttaggacgcggggttga

SEQ ID NO: 1794 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
tttaggacgcggggttgga

SEQ ID NO: 1795 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ttaggacgcggggttggga

SEQ ID NO: 1796 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
aggacgcggggttgggaca

SEQ ID NO: 1797 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gcggggttgggacggggta

SEQ ID NO: 1798 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gttgggacggggtcgggta

SEQ ID NO: 1799 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggacggggtcgggtggtta

SEQ ID NO: 1800 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ggctgaccggcctgggata

SEQ ID NO: 1801 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
gctgaccggcctgggatta

SEQ ID NO: 1802 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
ctgggattcctgccttcta

SEQ ID NO: 1803 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tgggattcctgccttctaa

SEQ ID NO: 1804 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-uridine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ggtctaggcccggtgagaa

SEQ ID NO: 1805 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
gtctaggcccggtgagaga

SEQ ID NO: 1806 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tctaggcccggtgagagaa

SEQ ID NO: 1807 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ctaggcccggtgagagaca

SEQ ID NO: 1808 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ggcccggtgagagactcca

SEQ ID NO: 1809 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
gcccggtgagagactccaa

SEQ ID NO: 1810 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
cccggtgagagactccaca

SEQ ID NO: 1811 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccccaccttccgacgctga

SEQ ID NO: 1812 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphate
cccaccttccgacgctgta

SEQ ID NO: 1813 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-uridine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
ccttccgacgctgtctaga

SEQ ID NO: 1814 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cttccgacgctgtctagga

SEQ ID NO: 1815 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphate
ttccgacgctgtctaggca

SEQ ID NO: 1816 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-deoxy-2'-fluoro-adenosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tccgacgctgtctaggcaa

SEQ ID NO: 1817 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-deoxy-2'-fluoro-cytidine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ccgacgctgtctaggcaaa

SEQ ID NO: 1818 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-deoxy-2'-fluoro-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-O-methyl-guanosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
cgacgctgtctaggcaaaa

SEQ ID NO: 1819 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggtgtcgggagggccattt

SEQ ID NO: 1820 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagggtgtcgggagggccatt

SEQ ID NO: 1821 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgctgtccgagggtgtcgtt

SEQ ID NO: 1822 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtgctgtccgagggtgtctt

SEQ ID NO: 1823 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtgctgtccgagggtgttt

SEQ ID NO: 1824 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggtgctgtccgagggtgtt

SEQ ID NO: 1825 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagggtgctgtccgagggttt

SEQ ID NO: 1826 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagggtgctgtccgagggtt

SEQ ID NO: 1827 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagggtgctgtccgaggtt

SEQ ID NO: 1828 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggagggtgctgtccgagtt

SEQ ID NO: 1829 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggggagggtgctgtccgatt

SEQ ID NO: 1830 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgcggggagggtgctgttt

SEQ ID NO: 1831 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccgcggggagggtgctgtt

SEQ ID NO: 1832 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttccgcggggagggtgcttt

SEQ ID NO: 1833 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctcgtccccgggcttcctt

SEQ ID NO: 1834 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcctcgtccccgggcttctt

SEQ ID NO: 1835 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtcctcgtccccgggctttt

SEQ ID NO: 1836 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgtcgccgtcctcgtcctt

SEQ ID NO: 1837 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccgtcgccgtcctcgtctt

SEQ ID NO: 1838 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctccgtcgccgtcctcgttt

SEQ ID NO: 1839 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctccgtcgccgtcctcgtt

SEQ ID NO: 1840 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtctccgtcgccgtcctctt

SEQ ID NO: 1841 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagtctccgtcgccgtccttt

SEQ ID NO: 1842 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagtctccgtcgccgtcctt

SEQ ID NO: 1843 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgagtctccgtcgccgtctt

SEQ ID NO: 1844 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacgagtctccgtcgccgttt

SEQ ID NO: 1845 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaaacgagtctccgtcgctt

SEQ ID NO: 1846 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccaaacgagtctccgtcgtt

SEQ ID NO: 1847 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccaaacgagtctccgtctt

SEQ ID NO: 1848 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtccaaacgagtctccgttt

SEQ ID NO: 1849 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtccaaacgagtctccgtt

SEQ ID NO: 1850 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggtccaaacgagtctcctt

SEQ ID NO: 1851 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggggtccaaacgagtctctt

SEQ ID NO: 1852 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggggtccaaacgagtcttt

SEQ ID NO: 1853 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggctcggggtccaaacgatt

SEQ ID NO: 1854 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctttggctcggggtccatt

SEQ ID NO: 1855 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgctttggctcggggtcctt

SEQ ID NO: 1856 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcgctttggctcggggtctt

SEQ ID NO: 1857 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcgctttggctcggggttt

SEQ ID NO: 1858 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctcgctttggctcggggtt

SEQ ID NO: 1859 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcctcgctttggctcgggtt

SEQ ID NO: 1860 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcctcgctttggctcggtt

SEQ ID NO: 1861 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggcctcgctttggctcgtt

SEQ ID NO: 1862 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagggcctcgctttggctctt

SEQ ID NO: 1863 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcagggcctcgctttggcttt

SEQ ID NO: 1864 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcagggcctcgctttggctt

SEQ ID NO: 1865 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcagggcctcgctttggtt

SEQ ID NO: 1866 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcgcagggcctcgctttgtt

SEQ ID NO: 1867 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcgcagggcctcgcttttt

SEQ ID NO: 1868 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctcgcagggcctcgctttt

SEQ ID NO: 1869 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggttccgctcaaagcagtt

SEQ ID NO: 1870 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgggttccgctcaaagcatt

SEQ ID NO: 1871 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacgggttccgctcaaagctt

SEQ ID NO: 1872 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttacgggttccgctcaaagtt

SEQ ID NO: 1873 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtacgggttccgctcaaatt

SEQ ID NO: 1874 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtacgggttccgctcaatt

SEQ ID NO: 1875 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggtacgggttccgctcatt

SEQ ID NO: 1876 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgggtacgggttccgctctt

SEQ ID NO: 1877 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgggtacgggttccgcttt

SEQ ID NO: 1878 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcgatgcccgggtacggtt

SEQ ID NO: 1879 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggcgatgcccgggtacgtt

SEQ ID NO: 1880 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtggcgatgcccgggtactt

SEQ ID NO: 1881 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtggcgatgcccgggtatt

SEQ ID NO: 1882 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctggtggcgatgcccgggtt

SEQ ID NO: 1883 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctggtggcgatgcccggtt

SEQ ID NO: 1884 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctctggtggcgatgcccgtt

SEQ ID NO: 1885 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctctggtggcgatgccctt

SEQ ID NO: 1886 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttctctggtggcgatgcctt

SEQ ID NO: 1887 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgttctctggtggcgatgctt

SEQ ID NO: 1888 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgttctctggtggcgatgtt

SEQ ID NO: 1889 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgttctctggtggcgattt

SEQ ID NO: 1890 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccgttctctggtggcgatt

SEQ ID NO: 1891 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagccgttctctggtggcgtt

SEQ ID NO: 1892 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgggccagccgttctctgtt

SEQ ID NO: 1893 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgggccagccgttctcttt

SEQ ID NO: 1894 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctgggccagccgttctctt

SEQ ID NO: 1895 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcctgggccagccgttcttt

SEQ ID NO: 1896 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcctgggccagccgttctt

SEQ ID NO: 1897 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taatgccgatggcctgggctt

SEQ ID NO: 1898 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaatgccgatggcctgggtt

SEQ ID NO: 1899 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggaatgccgatggcctggtt

SEQ ID NO: 1900 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggaatgccgatggcctgtt

SEQ ID NO: 1901 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccggaatgccgatggccttt

SEQ ID NO: 1902 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccggaatgccgatggcctt

SEQ ID NO: 1903 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctccggaatgccgatggctt

SEQ ID NO: 1904 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctccggaatgccgatggtt

SEQ ID NO: 1905 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggctccggaatgccgatgtt

SEQ ID NO: 1906 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggctccggaatgccgattt

SEQ ID NO: 1907 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgggctccggaatgccgatt

SEQ ID NO: 1908 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgggctccggaatgccgtt

SEQ ID NO: 1909 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctgggctccggaatgcctt

SEQ ID NO: 1910 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccctgggctccggaatgctt

SEQ ID NO: 1911 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taccctgggctccggaatgtt

SEQ ID NO: 1912 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaccctgggctccggaattt

SEQ ID NO: 1913 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggaccctgggctccggaatt

SEQ ID NO: 1914 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggaccctgggctccggatt

SEQ ID NO: 1915 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctggaccctgggctccggtt

SEQ ID NO: 1916 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctggaccctgggctccgtt

SEQ ID NO: 1917 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatctggaccctgggctcctt

SEQ ID NO: 1918 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgaaaccaaatctggacctt

SEQ ID NO: 1919 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgaaaccaaatctggactt

SEQ ID NO: 1920 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctgaaaccaaatctggatt

SEQ ID NO: 1921 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttctgaaaccaaatctggtt

SEQ ID NO: 1922 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tattctgaaaccaaatctgtt

SEQ ID NO: 1923 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcattctgaaaccaaatctt

SEQ ID NO: 1924 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctcattctgaaaccaaatt

SEQ ID NO: 1925 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctctcattctgaaaccaatt

SEQ ID NO: 1926 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctctcattctgaaaccatt

SEQ ID NO: 1927 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacctctcattctgaaacctt

SEQ ID NO: 1928 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgacctctcattctgaaactt

SEQ ID NO: 1929 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgacctctcattctgaaatt

SEQ ID NO: 1930 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtgacctctcattctgaatt

SEQ ID NO: 1931 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgtgacctctcattctgatt

SEQ ID NO: 1932 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgtgacctctcattctgtt

SEQ ID NO: 1933 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcgtgacctctcattcttt

SEQ ID NO: 1934 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggcgtgacctctcattctt

SEQ ID NO: 1935 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctggcgtgacctctcatttt

SEQ ID NO: 1936 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctggcgtgacctctcattt

SEQ ID NO: 1937 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagctggcgtgacctctcatt

SEQ ID NO: 1938 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcagctggcgtgacctctctt

SEQ ID NO: 1939 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcagctggcgtgacctcttt

SEQ ID NO: 1940 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcagctggcgtgacctctt

SEQ ID NO: 1941 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctcagctggcgtgaccttt

SEQ ID NO: 1942 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcctcagctggcgtgacctt

SEQ ID NO: 1943 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcctcagctggcgtgactt

SEQ ID NO: 1944 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgcctcagctggcgtgatt

SEQ ID NO: 1945 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctgcctcagctggcgtgtt

SEQ ID NO: 1946 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcccgccggtgctgcctcatt

SEQ ID NO: 1947 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcccgccggtgctgcctctt

SEQ ID NO: 1948 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttcccgccggtgctgccttt

SEQ ID NO: 1949 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tattcccgccggtgctgcctt

SEQ ID NO: 1950 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgattcccgccggtgctgctt

SEQ ID NO: 1951 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagattcccgccggtgctgtt

SEQ ID NO: 1952 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagattcccgccggtgcttt

SEQ ID NO: 1953 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgagattcccgccggtgctt

SEQ ID NO: 1954 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgagattcccgccggtgtt

SEQ ID NO: 1955 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggccgagattcccgccgtt

SEQ ID NO: 1956 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagggccgagattcccgcctt

SEQ ID NO: 1957 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcagggccgagattcccgctt

SEQ ID NO: 1958 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccagggccgagattcccgtt

SEQ ID NO: 1959 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccagggccgagattccctt

SEQ ID NO: 1960 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggccagggccgagattcctt

SEQ ID NO: 1961 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggccagggccgagattctt

SEQ ID NO: 1962 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctggcgggccgcgtctctt

SEQ ID NO: 1963 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttctggcgggccgcgtcttt

SEQ ID NO: 1964 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttttcgccggccttctggctt

SEQ ID NO: 1965 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctttcgccggccttctggtt

SEQ ID NO: 1966 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctttcgccggccttctgtt

SEQ ID NO: 1967 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgctttcgccggccttcttt

SEQ ID NO: 1968 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgctttcgccggccttctt

SEQ ID NO: 1969 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccgctttcgccggcctttt

SEQ ID NO: 1970 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacggcggtccgctttcgctt

SEQ ID NO: 1971 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgacggcggtccgctttcgtt

SEQ ID NO: 1972 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgacggcggtccgctttctt

SEQ ID NO: 1973 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtgacggcggtccgcttttt

SEQ ID NO: 1974 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtgacggcggtccgctttt

SEQ ID NO: 1975 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccggtgacggcggtccgtt

SEQ ID NO: 1976 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatccggtgacggcggtcctt

SEQ ID NO: 1977 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgatccggtgacggcggtctt

SEQ ID NO: 1978 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggatccggtgacggcggttt

SEQ ID NO: 1979 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggatccggtgacggcggtt

SEQ ID NO: 1980 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgggatccggtgacggcgtt

SEQ ID NO: 1981 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgggatccggtgacggctt

SEQ ID NO: 1982 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctgggatccggtgacggtt

SEQ ID NO: 1983 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtctgggatccggtgacgtt

SEQ ID NO: 1984 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtctgggatccggtgactt

SEQ ID NO: 1985 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggtctgggatccggtgatt

SEQ ID NO: 1986 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcggtctgggatccggtgtt

SEQ ID NO: 1987 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcggtctgggatccggttt

SEQ ID NO: 1988 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggcggtctgggatccggtt

SEQ ID NO: 1989 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagggcggtctgggatccgtt

SEQ ID NO: 1990 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcagggcggtctgggatcctt

SEQ ID NO: 1991 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcagggcggtctgggatctt

SEQ ID NO: 1992 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagcagggcggtctgggattt

SEQ ID NO: 1993 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagcagggcggtctgggatt

SEQ ID NO: 1994 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagcagggcggtctgggtt

SEQ ID NO: 1995 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggagcagggcggtctggtt

SEQ ID NO: 1996 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaggagcagggcggtctgtt

SEQ ID NO: 1997 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggaggagcagggcggtcttt

SEQ ID NO: 1998 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggaggagcagggcggtctt

SEQ ID NO: 1999 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcggaggagcagggcggttt

SEQ ID NO: 2000 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcaaaggctcggaggagtt

SEQ ID NO: 2001 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttctcaaaggctcggagtt

SEQ ID NO: 2002 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taagcgatccttctcaaagtt

SEQ ID NO: 2003 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taaagcgatccttctcaaatt

SEQ ID NO: 2004 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaaagcgatccttctcaatt

SEQ ID NO: 2005 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggaaagcgatccttctcatt

SEQ ID NO: 2006 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggaaagcgatccttctctt

SEQ ID NO: 2007 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctggaaagcgatccttcttt

SEQ ID NO: 2008 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctggaaagcgatccttctt

SEQ ID NO: 2009 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcctggaaagcgatcctttt

SEQ ID NO: 2010 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcctggaaagcgatccttt

SEQ ID NO: 2011 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatgcctggaaagcgatcctt

SEQ ID NO: 2012 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgatgcctggaaagcgatctt

SEQ ID NO: 2013 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgatgcctggaaagcgattt

SEQ ID NO: 2014 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgatgcctggaaagcgatt

SEQ ID NO: 2015 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcgatgcctggaaagcgtt

SEQ ID NO: 2016 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggcgatgcctggaaagctt

SEQ ID NO: 2017 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcggcgatgcctggaaagtt

SEQ ID NO: 2018 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcggcgatgcctggaaatt

SEQ ID NO: 2019 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggcggcgatgcctggaatt

SEQ ID NO: 2020 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctggccagctcctcccggtt

SEQ ID NO: 2021 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctggccagctcctcccgtt

SEQ ID NO: 2022 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctctggccagctcctccctt

SEQ ID NO: 2023 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctctggccagctcctcctt

SEQ ID NO: 2024 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctctctggccagctcctctt

SEQ ID NO: 2025 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctctctggccagctccttt

SEQ ID NO: 2026 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtctctctggccagctcctt

SEQ ID NO: 2027 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgtctctctggccagctctt

SEQ ID NO: 2028 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgtctctctggccagcttt

SEQ ID NO: 2029 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcccgtctctctggccagctt

SEQ ID NO: 2030 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaggcccgtctctctggctt

SEQ ID NO: 2031 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggaggcccgtctctctggtt

SEQ ID NO: 2032 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggaggcccgtctctctgtt

SEQ ID NO: 2033 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgggaggcccgtctctcttt

SEQ ID NO: 2034 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctggactccgggaggcctt

SEQ ID NO: 2035 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcctggactccgggaggctt

SEQ ID NO: 2036 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatcctggactccgggaggtt

SEQ ID NO: 2037 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taatcctggactccgggagtt

SEQ ID NO: 2038 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaatcctggactccgggatt

SEQ ID NO: 2039 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgaatcctggactccgggtt

SEQ ID NO: 2040 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgaatcctggactccggtt

SEQ ID NO: 2041 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctgaatcctggactccgtt

SEQ ID NO: 2042 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatctgaatcctggactcctt

SEQ ID NO: 2043 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgatctgaatcctggactctt

SEQ ID NO: 2044 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagatctgaatcctggacttt

SEQ ID NO: 2045 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taaccagatctgaatcctgtt

SEQ ID NO: 2046 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taaaccagatctgaatccttt

SEQ ID NO: 2047 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaaaccagatctgaatcctt

SEQ ID NO: 2048 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgaaaccagatctgaatctt

SEQ ID NO: 2049 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgaaaccagatctgaattt

SEQ ID NO: 2050 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttcgattctgaaaccagtt

SEQ ID NO: 2051 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccttcgattctgaaaccatt

SEQ ID NO: 2052 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcccttcgattctgaaacctt

SEQ ID NO: 2053 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcccttcgattctgaaactt

SEQ ID NO: 2054 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcccttcgattctgaaatt

SEQ ID NO: 2055 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggcccttcgattctgaatt

SEQ ID NO: 2056 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctggcccttcgattctgatt

SEQ ID NO: 2057 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctggcccttcgattctgtt

SEQ ID NO: 2058 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcctggcccttcgattcttt

SEQ ID NO: 2059 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcctggcccttcgattctt

SEQ ID NO: 2060 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtgcctggcccttcgatttt

SEQ ID NO: 2061 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtgcctggcccttcgattt

SEQ ID NO: 2062 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggtgcctggcccttcgatt

SEQ ID NO: 2063 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagggagcagggtgacccctt

SEQ ID NO: 2064 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagggagcagggtgaccctt

SEQ ID NO: 2065 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgagggagcagggtgacctt

SEQ ID NO: 2066 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacgagggagcagggtgactt

SEQ ID NO: 2067 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcacgagggagcagggtgatt

SEQ ID NO: 2068 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccacgagggagcagggtgtt

SEQ ID NO: 2069 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacccacgagggagcagggtt

SEQ ID NO: 2070 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgacccacgagggagcaggtt

SEQ ID NO: 2071 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgacccacgagggagcagtt

SEQ ID NO: 2072 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgacccacgagggagcatt

SEQ ID NO: 2073 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcgacccacgagggagctt

SEQ ID NO: 2074 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggcgacccacgagggagtt

SEQ ID NO: 2075 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taaggcgacccacgagggatt

SEQ ID NO: 2076 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaaggcgacccacgagggtt

SEQ ID NO: 2077 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgaaggcgacccacgaggtt

SEQ ID NO: 2078 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgaaggcgacccacgagtt

SEQ ID NO: 2079 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcgaaggcgacccacgatt

SEQ ID NO: 2080 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgtgggcgaaggcgaccctt

SEQ ID NO: 2081 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtgtgggcgaaggcgacctt

SEQ ID NO: 2082 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtgtgggcgaaggcgactt

SEQ ID NO: 2083 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggtgtgggcgaaggcgatt

SEQ ID NO: 2084 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccccacgcgccggtgtgtt

SEQ ID NO: 2085 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttccccacgcgccggtgttt

SEQ ID NO: 2086 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagccccgttccccacgcgtt

SEQ ID NO: 2087 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taagccccgttccccacgctt

SEQ ID NO: 2088 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgtggggtgcgggaagcctt

SEQ ID NO: 2089 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacgtggggtgcgggaagctt

SEQ ID NO: 2090 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgctgcctggctcacgaatt

SEQ ID NO: 2091 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcgctgcctggctcacgatt

SEQ ID NO: 2092 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcgctgcctggctcacgtt

SEQ ID NO: 2093 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctcgctgcctggctcactt

SEQ ID NO: 2094 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagatcccctctgccggcgtt

SEQ ID NO: 2095 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagatcccctctgccggctt

SEQ ID NO: 2096 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagatcccctctgccggtt

SEQ ID NO: 2097 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggagatcccctctgccgtt

SEQ ID NO: 2098 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgggagatcccctctgcctt

SEQ ID NO: 2099 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggcaggttgggagatcctt

SEQ ID NO: 2100 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggggcaggttgggagatctt

SEQ ID NO: 2101 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggggcaggttgggagattt

SEQ ID NO: 2102 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccggggcaggttgggagatt

SEQ ID NO: 2103 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtaggcgaaatccccgcgtt

SEQ ID NO: 2104 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgtaggcgaaatccccgctt

SEQ ID NO: 2105 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgtaggcgaaatccccgtt

SEQ ID NO: 2106 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcgtaggcgaaatcccctt

SEQ ID NO: 2107 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggcgtaggcgaaatccctt

SEQ ID NO: 2108 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcggcgtaggcgaaatcctt

SEQ ID NO: 2109 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcggcgtaggcgaaatctt

SEQ ID NO: 2110 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggcggcgtaggcgaaattt

SEQ ID NO: 2111 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggggcggcgtaggcgaaatt

SEQ ID NO: 2112 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagggtgggagagcgccctt

SEQ ID NO: 2113 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgagggtgggagagcgcctt

SEQ ID NO: 2114 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgagggtgggagagcgctt

SEQ ID NO: 2115 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctgagggtgggagagcgtt

SEQ ID NO: 2116 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcctgagggtgggagagctt

SEQ ID NO: 2117 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagcctgagggtgggagagtt

SEQ ID NO: 2118 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagcctgagggtgggagatt

SEQ ID NO: 2119 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagcctgagggtgggagtt

SEQ ID NO: 2120 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggagcctgagggtgggatt

SEQ ID NO: 2121 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaggagcctgagggtgggtt

SEQ ID NO: 2122 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgaggagcctgagggtggtt

SEQ ID NO: 2123 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgaggagcctgagggtgtt

SEQ ID NO: 2124 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taccgaggagcctgagggttt

SEQ ID NO: 2125 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaccgaggagcctgagggtt

SEQ ID NO: 2126 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccaccgaggagcctgaggtt

SEQ ID NO: 2127 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccaccgaggagcctgagtt

SEQ ID NO: 2128 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcggaggccaccgaggagtt

SEQ ID NO: 2129 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcggaggccaccgaggatt

SEQ ID NO: 2130 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttgcccgggtgcggaggctt

SEQ ID NO: 2131 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttttgcccgggtgcggaggtt

SEQ ID NO: 2132 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttttgcccgggtgcggagtt

SEQ ID NO: 2133 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttttgcccgggtgcggatt

SEQ ID NO: 2134 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcttttgcccgggtgcggtt

SEQ ID NO: 2135 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcttttgcccgggtgcgtt

SEQ ID NO: 2136 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctcccggcttttgcccgtt

SEQ ID NO: 2137 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcctcccggcttttgccctt

SEQ ID NO: 2138 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtcctcccggcttttgcctt

SEQ ID NO: 2139 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtcctcccggcttttgctt

SEQ ID NO: 2140 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggctgtgccaccgcgcagtt

SEQ ID NO: 2141 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggctgtgccaccgcgcatt

SEQ ID NO: 2142 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagcgggcccaggctgtgtt

SEQ ID NO: 2143 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgagcgggcccaggctgttt

SEQ ID NO: 2144 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttgagcgggcccaggctgtt

SEQ ID NO: 2145 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttgagcgggcccaggcttt

SEQ ID NO: 2146 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcaccccttggccctgcgtt

SEQ ID NO: 2147 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagcaccccttggccctgctt

SEQ ID NO: 2148 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcccctgggacgtgggtggtt

SEQ ID NO: 2149 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcccctgggacgtgggtgtt

SEQ ID NO: 2150 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcccctgggacgtgggttt

SEQ ID NO: 2151 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taccacggactcccctgggtt

SEQ ID NO: 2152 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaccacggactcccctggtt

SEQ ID NO: 2153 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccaccacggactcccctgtt

SEQ ID NO: 2154 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcccaccacggactccccttt

SEQ ID NO: 2155 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggggttcccacgccgcctt

SEQ ID NO: 2156 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagctgccccggcttggtt

SEQ ID NO: 2157 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggagctgccccggcttgtt

SEQ ID NO: 2158 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtggagctgccccggctttt

SEQ ID NO: 2159 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggggaggtggagctgccctt

SEQ ID NO: 2160 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggggaggtggagctgcctt

SEQ ID NO: 2161 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctggggaggtggagctgctt

SEQ ID NO: 2162 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctggggaggtggagctgtt

SEQ ID NO: 2163 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcatctgcccctgccgcgtt

SEQ ID NO: 2164 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttgcatctgcccctgccgtt

SEQ ID NO: 2165 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttgcatctgcccctgcctt

SEQ ID NO: 2166 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccttgcatctgcccctgctt

SEQ ID NO: 2167 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccttgcatctgcccctgtt

SEQ ID NO: 2168 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgccttgcatctgccccttt

SEQ ID NO: 2169 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgccgggatgccttgcatt

SEQ ID NO: 2170 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggcgccgggatgccttgtt

SEQ ID NO: 2171 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagggcgccgggatgcctttt

SEQ ID NO: 2172 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctggagcgcctgggaggtt

SEQ ID NO: 2173 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagtgcagaccagggcgcctt

SEQ ID NO: 2174 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagtgcagaccagggcgctt

SEQ ID NO: 2175 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagtgcagaccagggcgtt

SEQ ID NO: 2176 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggagtgcagaccagggctt

SEQ ID NO: 2177 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggggagtgcagaccagggtt

SEQ ID NO: 2178 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggggagtgcagaccaggtt

SEQ ID NO: 2179 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaggggagtgcagaccagtt

SEQ ID NO: 2180 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcaggggagtgcagaccatt

SEQ ID NO: 2181 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcaggggagtgcagacctt

SEQ ID NO: 2182 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgcaggggagtgcagactt

SEQ ID NO: 2183 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccgcaggggagtgcagatt

SEQ ID NO: 2184 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggccgcaggggagtgcagtt

SEQ ID NO: 2185 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggccgcaggggagtgcatt

SEQ ID NO: 2186 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcaggccgcaggggagtgtt

SEQ ID NO: 2187 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagcaggccgcaggggagttt

SEQ ID NO: 2188 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcagcaggccgcaggggatt

SEQ ID NO: 2189 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccagcagcaggccgcaggtt

SEQ ID NO: 2190 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccagcagcaggccgcagtt

SEQ ID NO: 2191 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatccagcagcaggccgcatt

SEQ ID NO: 2192 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcatccagcagcaggccgctt

SEQ ID NO: 2193 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcatccagcagcaggccgtt

SEQ ID NO: 2194 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcatccagcagcaggcctt

SEQ ID NO: 2195 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctcatccagcagcaggctt

SEQ ID NO: 2196 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagctcatccagcagcaggtt

SEQ ID NO: 2197 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagctcatccagcagcagtt

SEQ ID NO: 2198 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagctcatccagcagcatt

SEQ ID NO: 2199 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggagctcatccagcagctt

SEQ ID NO: 2200 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaggagctcatccagcagtt

SEQ ID NO: 2201 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccaggagctcatccagcatt

SEQ ID NO: 2202 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccaggagctcatccagctt

SEQ ID NO: 2203 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tactccgggctcgccaggatt

SEQ ID NO: 2204 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taactccgggctcgccaggtt

SEQ ID NO: 2205 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taaactccgggctcgccagtt

SEQ ID NO: 2206 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcagaaactccgggctctt

SEQ ID NO: 2207 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgcagaaactccgggcttt

SEQ ID NO: 2208 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctgcagaaactccgggctt

SEQ ID NO: 2209 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgctgcagaaactccgggtt

SEQ ID NO: 2210 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgctgcagaaactccggtt

SEQ ID NO: 2211 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctgctgcagaaactccgtt

SEQ ID NO: 2212 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcctgctgcagaaactcctt

SEQ ID NO: 2213 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcctgctgcagaaactctt

SEQ ID NO: 2214 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgcctgctgcagaaacttt

SEQ ID NO: 2215 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcgcctgctgcagaaactt

SEQ ID NO: 2216 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttgcgcctgctgcagaaatt

SEQ ID NO: 2217 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgttgcgcctgctgcagaatt

SEQ ID NO: 2218 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggttgcgcctgctgcagatt

SEQ ID NO: 2219 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggttgcgcctgctgcagtt

SEQ ID NO: 2220 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaggttgcgcctgctgcatt

SEQ ID NO: 2221 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagaggttgcgcctgctgctt

SEQ ID NO: 2222 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagaggttgcgcctgctgtt

SEQ ID NO: 2223 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagaggttgcgcctgcttt

SEQ ID NO: 2224 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggagaggttgcgcctgctt

SEQ ID NO: 2225 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttaggagaggttgcgcctgtt

SEQ ID NO: 2226 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctaggagaggttgcgccttt

SEQ ID NO: 2227 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctaggagaggttgcgcctt

SEQ ID NO: 2228 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttctaggagaggttgcgctt

SEQ ID NO: 2229 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttttctaggagaggttgcgtt

SEQ ID NO: 2230 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtttctaggagaggttgctt

SEQ ID NO: 2231 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgtttctaggagaggttgtt

SEQ ID NO: 2232 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgtttctaggagaggtttt

SEQ ID NO: 2233 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggcctccgtttctaggatt

SEQ ID NO: 2234 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggggcctccgtttctaggtt

SEQ ID NO: 2235 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggggcctccgtttctagtt

SEQ ID NO: 2236 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagtggagtctctcaccggtt

SEQ ID NO: 2237 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagtggagtctctcaccgtt

SEQ ID NO: 2238 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagtggagtctctcacctt

SEQ ID NO: 2239 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttcacggaagaacaagggtt

SEQ ID NO: 2240 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttttcacggaagaacaaggtt

SEQ ID NO: 2241 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatttcacggaagaacaagtt

SEQ ID NO: 2242 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taatttcacggaagaacaatt

SEQ ID NO: 2243 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaatttcacggaagaacatt

SEQ ID NO: 2244 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagaatttcacggaagaactt

SEQ ID NO: 2245 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcagaatttcacggaagaatt

SEQ ID NO: 2246 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccagaatttcacggaagatt

SEQ ID NO: 2247 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccagaatttcacggaagtt

SEQ ID NO: 2248 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagacattcagccagaatt

SEQ ID NO: 2249 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggagacattcagccagatt

SEQ ID NO: 2250 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtttgcctagacagcgtctt

SEQ ID NO: 2251 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtttgcctagacagcgttt

SEQ ID NO: 2252 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggtttgcctagacagcgtt

SEQ ID NO: 2253 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaggtttgcctagacagctt

SEQ ID NO: 2254 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccaggtttgcctagacagtt

SEQ ID NO: 2255 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccaggtttgcctagacatt

SEQ ID NO: 2256 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatccaggtttgcctagactt

SEQ ID NO: 2257 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taatccaggtttgcctagatt

SEQ ID NO: 2258 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttaatccaggtttgcctagtt

SEQ ID NO: 2259 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctaatccaggtttgcctatt

SEQ ID NO: 2260 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctaatccaggtttgccttt

SEQ ID NO: 2261 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctctaatccaggtttgcctt

SEQ ID NO: 2262 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tactctaatccaggtttgctt

SEQ ID NO: 2263 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taactctaatccaggtttgtt

SEQ ID NO: 2264 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttaactctaatccaggttttt

SEQ ID NO: 2265 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtaactctaatccaggtttt

SEQ ID NO: 2266 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgtaactctaatccaggttt

SEQ ID NO: 2267 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatgtaactctaatccaggtt

SEQ ID NO: 2268 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgatgtaactctaatccagtt

SEQ ID NO: 2269 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagatgtaactctaatccatt

SEQ ID NO: 2270 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgagatgtaactctaatcctt

SEQ ID NO: 2271 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagatgtaactctaatctt

SEQ ID NO: 2272 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggagatgtaactctaattt

SEQ ID NO: 2273 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaggagatgtaactctaatt

SEQ ID NO: 2274 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccaggagatgtaactctatt

SEQ ID NO: 2275 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttccaggagatgtaactcttt

SEQ ID NO: 2276 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tactaatcatccaggagattt

SEQ ID NO: 2277 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taactaatcatccaggagatt

SEQ ID NO: 2278 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaactaatcatccaggagtt

SEQ ID NO: 2279 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgaactaatcatccaggatt

SEQ ID NO: 2280 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgaactaatcatccaggtt

SEQ ID NO: 2281 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctgaactaatcatccagtt

SEQ ID NO: 2282 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttccgcggggagggtgctt

SEQ ID NO: 2283 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcttccgcggggagggtgtt

SEQ ID NO: 2284 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcttccgcggggagggttt

SEQ ID NO: 2285 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgggcttccgcggggaggtt

SEQ ID NO: 2286 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtccccgggcttccgcggtt

SEQ ID NO: 2287 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcgtccccgggcttccgctt

SEQ ID NO: 2288 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcgtccccgggcttccgtt

SEQ ID NO: 2289 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcattctgaaaccaaattt

SEQ ID NO: 2290 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccgagattcccgccggttt

SEQ ID NO: 2291 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgtctcccgggccagggtt

SEQ ID NO: 2292 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcgtctcccgggccaggtt

SEQ ID NO: 2293 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgcgtctcccgggccagtt

SEQ ID NO: 2294 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttctggcgggccgcgtctt

SEQ ID NO: 2295 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccttctggcgggccgcgttt

SEQ ID NO: 2296 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtccgctttcgccggccttt

SEQ ID NO: 2297 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtccgctttcgccggcctt

SEQ ID NO: 2298 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggtccgctttcgccggctt

SEQ ID NO: 2299 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcggaggagcagggcggtt

SEQ ID NO: 2300 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgggcggcgatgcctggtt

SEQ ID NO: 2301 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctcccgggcggcgatgctt

SEQ ID NO: 2302 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcctcccgggcggcgatgtt

SEQ ID NO: 2303 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctcctcccgggcggcgattt

SEQ ID NO: 2304 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctcctcccgggcggcgatt

SEQ ID NO: 2305 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagctcctcccgggcggcgtt

SEQ ID NO: 2306 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtcccgggtgcctggccctt

SEQ ID NO: 2307 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgccctgccaccctgtctt

SEQ ID NO: 2308 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcgccctgccaccctgttt

SEQ ID NO: 2309 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgggcgccctgccacccttt

SEQ ID NO: 2310 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgggcgccctgccaccctt

SEQ ID NO: 2311 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgcgggcgccctgccactt

SEQ ID NO: 2312 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgctgcacaggccgccttt

SEQ ID NO: 2313 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcgctgcacaggccgcctt

SEQ ID NO: 2314 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgcgctgcacaggccgctt

SEQ ID NO: 2315 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccggtgtgggcgaaggcgtt

SEQ ID NO: 2316 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgttccccacgcgccggtgtt

SEQ ID NO: 2317 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgttccccacgcgccggttt

SEQ ID NO: 2318 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgttccccacgcgccggtt

SEQ ID NO: 2319 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcccgttccccacgcgccgtt

SEQ ID NO: 2320 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccccgttccccacgcgctt

SEQ ID NO: 2321 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtggggtgcgggaagccctt

SEQ ID NO: 2322 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcagggcacgtggggtgtt

SEQ ID NO: 2323 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcgcagggcacgtggggtt

SEQ ID NO: 2324 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcgcgcagggcacgtggtt

SEQ ID NO: 2325 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaggcgcgcagggcacgttt

SEQ ID NO: 2326 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagagccccaggcgcgcagtt

SEQ ID NO: 2327 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcctggctcacgaaagctt

SEQ ID NO: 2328 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgcctggctcacgaaagtt

SEQ ID NO: 2329 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctgcctggctcacgaaatt

SEQ ID NO: 2330 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcggccctcgctgcctggtt

SEQ ID NO: 2331 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggcctggctgggctgcagtt

SEQ ID NO: 2332 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcggcctggctgggctgctt

SEQ ID NO: 2333 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccggcgcggcctggctggtt

SEQ ID NO: 2334 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcccctctgccggcgcggtt

SEQ ID NO: 2335 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcgccggggcaggttggtt

SEQ ID NO: 2336 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcgcgccggggcaggtttt

SEQ ID NO: 2337 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttaggcgaaatccccgcgctt

SEQ ID NO: 2338 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcggggcggcgtaggcgaatt

SEQ ID NO: 2339 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccggggcggcgtaggcgtt

SEQ ID NO: 2340 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgccccgtccggaggagcctt

SEQ ID NO: 2341 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgccccgtccggaggagctt

SEQ ID NO: 2342 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagggtgggagagcgcccctt

SEQ ID NO: 2343 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgcgggtcccggtcctctt

SEQ ID NO: 2344 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgtcgcgctgcgggtccctt

SEQ ID NO: 2345 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggccgtcgcgctgcgggtt

SEQ ID NO: 2346 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcaggggcccggcaggctt

SEQ ID NO: 2347 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctgtgccaccgcgcaggtt

SEQ ID NO: 2348 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaggctgtgccaccgcgctt

SEQ ID NO: 2349 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccaggctgtgccaccgcgtt

SEQ ID NO: 2350 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcccaggctgtgccaccgtt

SEQ ID NO: 2351 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagcgggcccaggctgtgctt

SEQ ID NO: 2352 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgcttgagcgggcccaggtt

SEQ ID NO: 2353 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaccccttggccctgcggtt

SEQ ID NO: 2354 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgtgggtggcgcaagcactt

SEQ ID NO: 2355 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacgtgggtggcgcaagcatt

SEQ ID NO: 2356 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgacgtgggtggcgcaagctt

SEQ ID NO: 2357 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggacgtgggtggcgcaagtt

SEQ ID NO: 2358 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgggacgtgggtggcgcatt

SEQ ID NO: 2359 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccagccccaccacggacttt

SEQ ID NO: 2360 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacctggggaccccggccctt

SEQ ID NO: 2361 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgacctggggaccccggtt

SEQ ID NO: 2362 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgttcccacgccgccccggtt

SEQ ID NO: 2363 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgggctggggaggtggagtt

SEQ ID NO: 2364 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-uridine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcgcgggctggggaggtgtt

SEQ ID NO: 2365 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggcgcgggctggggaggtt

SEQ ID NO: 2366 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccctgccgcgcggaggcgtt

SEQ ID NO: 2367 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctgcccctgccgcgcggtt

SEQ ID NO: 2368 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcatctgcccctgccgcgctt

SEQ ID NO: 2369 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgctcctggagcgcctgggtt

SEQ ID NO: 2370 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagaccagggcgccggctctt

SEQ ID NO: 2371 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcagaccagggcgccggctt

SEQ ID NO: 2372 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcagaccagggcgccggtt

SEQ ID NO: 2373 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtgcagaccagggcgccgtt

SEQ ID NO: 2374 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcagcaggccgcaggggagtt

SEQ ID NO: 2375 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgccaggagctcatccagtt

SEQ ID NO: 2376 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcgaggcctccagctcccctt

SEQ ID NO: 2377 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttccgaggcctccagctctt

SEQ ID NO: 2378 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttccgaggcctccagcttt

SEQ ID NO: 2379 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcttccgaggcctccagctt

SEQ ID NO: 2380 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcttccagcgaggcggcctt

SEQ ID NO: 2381 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcttccagcgaggcggctt

SEQ ID NO: 2382 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtgcttccagcgaggcggtt

SEQ ID NO: 2383 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtgcttccagcgaggcgtt

SEQ ID NO: 2384 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgggtgcttccagcgaggctt

SEQ ID NO: 2385 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taggggtgcttccagcgagtt

SEQ ID NO: 2386 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-O-methyl-uridine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtattcttcctcgctgagtt

SEQ ID NO: 2387 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggtattcttcctcgctgatt

SEQ ID NO: 2388 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagagcccggtattcttcctt

SEQ ID NO: 2389 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcctccagcagagcccggtt

SEQ ID NO: 2390 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttaaagctcctccagcagatt

SEQ ID NO: 2391 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctaaagctcctccagcagtt

SEQ ID NO: 2392 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcctaaagctcctccagctt

SEQ ID NO: 2393 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtcctaaagctcctccagtt

SEQ ID NO: 2394 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccgcgtcctaaagctccttt

SEQ ID NO: 2395 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcccgcgtcctaaagctcctt

SEQ ID NO: 2396 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-cytidine-3'-phosphate
  modified_base 18: mod_base = OTHER; note = 2'-O-methyl-uridine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccccgcgtcctaaagctctt

SEQ ID NO: 2397 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-uridine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taccccgcgtcctaaagcttt

SEQ ID NO: 2398 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taaccccgcgtcctaaagctt

SEQ ID NO: 2399 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcaaccccgcgtcctaaagtt

SEQ ID NO: 2400 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tccaaccccgcgtcctaaatt

SEQ ID NO: 2401 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcccaaccccgcgtcctaatt

SEQ ID NO: 2402 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtcccaaccccgcgtccttt

SEQ ID NO: 2403 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taccccgtcccaaccccgctt

SEQ ID NO: 2404 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacccgaccccgtcccaactt

SEQ ID NO: 2405 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taaccacccgaccccgtcctt

SEQ ID NO: 2406 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatcccaggccggtcagcctt

SEQ ID NO: 2407 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taatcccaggccggtcagctt

SEQ ID NO: 2408 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tagaaggcaggaatcccagtt

SEQ ID NO: 2409 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttagaaggcaggaatcccatt

SEQ ID NO: 2410 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-uridine-3'-phosphate
  modified_base 15: mod_base = OTHER; note = 2'-O-methyl-adenosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctcaccgggcctagacctt

SEQ ID NO: 2411 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-uridine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctctcaccgggcctagactt

SEQ ID NO: 2412 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-uridine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctctcaccgggcctagatt

SEQ ID NO: 2413 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-uridine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtctctcaccgggcctagtt

SEQ ID NO: 2414 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-uridine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tggagtctctcaccgggcctt

SEQ ID NO: 2415 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttggagtctctcaccgggctt

SEQ ID NO: 2416 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgtggagtctctcaccgggtt

SEQ ID NO: 2417 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-adenosine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcagcgtcggaaggtggggtt

SEQ ID NO: 2418 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-cytidine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tacagcgtcggaaggtgggtt

SEQ ID NO: 2419 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-adenosine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-guanosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-adenosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctagacagcgtcggaaggtt

SEQ ID NO: 2420 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-deoxy-2'-fluoro-guanosine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-adenosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcctagacagcgtcggaagtt

SEQ ID NO: 2421 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-deoxy-2'-fluoro-adenosine-3'-phosphate
  modified_base 7: mod_base = OTHER; note = 2'-O-methyl-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgcctagacagcgtcggaatt

SEQ ID NO: 2422 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-uridine-3'-phosphate
  modified_base 7: mod_base = OTHER; note = 2'-O-methyl-adenosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-uridine-3'-phosphate
  modified_base 16: mod_base = OTHER; note = 2'-deoxy-2'-fluoro-cytidine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgcctagacagcgtcggatt

SEQ ID NO: 2423 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-cytidine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-guanosine-3'-phosphate
  modified_base 16: mod_base = OTHER; note = 2'-deoxy-2'-fluoro-uridine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tttgcctagacagcgtcggtt

SEQ ID NO: 2424 - RNA, 21 nt, synthetic construct
  source 1..21: mol_type = other RNA
  modified_base 1: mod_base = OTHER; note = 2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-deoxy-2'-fluoro-cytidine-3'-phosphate
  modified_base 7: mod_base = OTHER; note = 2'-O-methyl-cytidine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-deoxy-2'-fluoro-guanosine-3'-phosphate
  modified_base 17: mod_base = OTHER; note = 2'-O-methyl-uridine-3'-phosphate
  modified_base 18: mod_base = OTHER; note = 2'-O-methyl-cytidine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttttgcctagacagcgtcgtt

SEQ ID NO: 2425 - RNA, 1710 nt, Homo sapiens
  source 1..1710: mol_type = genomic RNA
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagaggggatctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcggtggcctctctttcgcggggaacacctggctggctacggaggggcgtgtctccgccccgccccctccaccgggctgaccggcctgggattcctgccttctaggtctaggcccggtgagagactccactccgcggagaactgcctttctttcctgggcatcccggggatcccagagccggcccaggtaccagcagacctgcgcgcagtgcgcaccccggctgacgtgcaagggagctcgctggcctctctgtgcccttgttcttccgtgaaattctggctgaatgtctccccccaccttccgacgctgtctaggcaaacctggattagagttacatctcctggatgattagttcagagatatattaaaatgccccctccctgtggatcctatag

SEQ ID NO: 2426 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-deoxy-2'-fluoro-guanosine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-deoxy-2'-fluoro-adenosine-3'-phosphate
  modified_base 13: mod_base = OTHER; note = 2'-O-methyl-uridine-3'-phosphate
  modified_base 14: mod_base = OTHER; note = 2'-O-methyl-cytidine-3'-phosphate
  modified_base 15: mod_base = OTHER; note = 2'-O-methyl-guanosine-3'-phosphate
  modified_base 16: mod_base = OTHER; note = 2'-O-methyl-adenosine-3'-phosphate
  modified_base 17: mod_base = OTHER; note = 2'-deoxy-2'-fluoro-adenosine-3'-phosphorothioate
  modified_base 18: mod_base = OTHER; note = 2'-O-methyl-guanosine-3'-phosphorothioate
  modified_base 19: mod_base = OTHER; note = 2'-O-methyl-adenosine-3'-phosphate
ctggtttcagaatcgaaga

SEQ ID NO: 2427 - RNA, 19 nt, synthetic construct
  source 1..19: mol_type = other RNA
  modified_base 1: mod_base = OTHER; note = 2'-O-methyl-adenosine-3'-phosphorothioate
  modified_base 2: mod_base = OTHER; note = 2'-O-methyl-guanosine-3'-phosphorothioate
  modified_base 3: mod_base = OTHER; note = 2'-deoxy-2'-fluoro-guanosine-3'-phosphate
  modified_base 4: mod_base = OTHER; note = 2'-O-methyl-cytidine-3'-phosphate
  modified_base 5: mod_base = OTHER; note = 2'-O-methyl-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-cytidine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-deoxy-2'-fluoro-guanosine-3'-phosphate
  modified_base 13: mod_base = OTHER; note = 2'-O-methyl-adenosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-adenosine-3'-phosphate
  modified_base 17: mod_base = OTHER; note = 2'-deoxy-2'-fluoro-guanosine-3'-phosphorothioate
  modified_base 18: mod_base = OTHER; note = 2'-O-methyl-adenosine-3'-phosphorothioate
  modified_base 19: mod_base = OTHER; note = 2'-O-methyl-adenosine-3'-phosphate
aggcaaacctggattagaa

SEQ ID NO: 2428 - RNA, 19 nt, synthetic construct
  source 1..19: mol_type = other RNA
  modified_base 1: mod_base = OTHER; note = 2'-O-methyl-guanosine-3'-phosphorothioate
  modified_base 2: mod_base = OTHER; note = 2'-O-methyl-guanosine-3'-phosphorothioate
  modified_base 3: mod_base = OTHER; note = 2'-deoxy-2'-fluoro-cytidine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-cytidine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-guanosine-3'-phosphate
  modified_base 12: mod_base = OTHER; note = 2'-deoxy-2'-fluoro-adenosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-deoxy-2'-fluoro-adenosine-3'-phosphorothioate
  modified_base 18: mod_base = OTHER; note = 2'-O-methyl-guanosine-3'-phosphorothioate
  modified_base 19: mod_base = OTHER; note = 2'-O-methyl-adenosine-3'-phosphate
ggcaaacctggattagaga

SEQ ID NO: 2429 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-deoxy-2'-fluoro-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-deoxy-2'-fluoro-guanosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-deoxy-2'-fluoro-adenosine-3'-phosphorothioate
  modified_base 18: mod_base = OTHER; note = 2'-O-methyl-uridine-3'-phosphorothioate
  modified_base 19: mod_base = OTHER; note = 2'-O-methyl-adenosine-3'-phosphate
cctggattagagttacata

SEQ ID NO: 2430 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-deoxy-2'-fluoro-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-deoxy-2'-fluoro-uridine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-deoxy-2'-fluoro-uridine-3'-phosphorothioate
  modified_base 18: mod_base = OTHER; note = 2'-O-methyl-cytidine-3'-phosphorothioate
  modified_base 19: mod_base = OTHER; note = 2'-O-methyl-adenosine-3'-phosphate
ctggattagagttacatca

SEQ ID NO: 2431 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-deoxy-2'-fluoro-uridine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-guanosine-3'-phosphate
  modified_base 12: mod_base = OTHER; note = 2'-deoxy-2'-fluoro-adenosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-deoxy-2'-fluoro-uridine-3'-phosphorothioate
  modified_base 18: mod_base = OTHER; note = 2'-O-methyl-uridine-3'-phosphorothioate
  modified_base 19: mod_base = OTHER; note = 2'-O-methyl-adenosine-3'-phosphate
tctcctggatgattagtta

SEQ ID NO: 2432 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-deoxy-2'-fluoro-cytidine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-guanosine-3'-phosphate
  modified_base 11: mod_base = OTHER; note = 2'-O-methyl-adenosine-3'-phosphate
  modified_base 12: mod_base = OTHER; note = 2'-deoxy-2'-fluoro-uridine-3'-phosphate
  modified_base 13: mod_base = OTHER; note = 2'-O-methyl-uridine-3'-phosphate
  modified_base 14: mod_base = OTHER; note = 2'-O-methyl-adenosine-3'-phosphate
  modified_base 15: mod_base = OTHER; note = 2'-O-methyl-guanosine-3'-phosphate
  modified_base 16: mod_base = OTHER; note = 2'-O-methyl-uridine-3'-phosphate
  modified_base 17: mod_base = OTHER; note = 2'-deoxy-2'-fluoro-uridine-3'-phosphorothioate
  modified_base 18: mod_base = OTHER; note = 2'-O-methyl-cytidine-3'-phosphorothioate
  modified_base 19: mod_base = OTHER; note = 2'-O-methyl-adenosine-3'-phosphate
ctcctggatgattagttca

SEQ ID NO: 2433 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-deoxy-2'-fluoro-guanosine-3'-phosphate
  modified_base 4: mod_base = OTHER; note = 2'-O-methyl-cytidine-3'-phosphate
  modified_base 5: mod_base = OTHER; note = 2'-O-methyl-guanosine-3'-phosphate
  modified_base 6: mod_base = OTHER; note = 2'-O-methyl-cytidine-3'-phosphate
  modified_base 7: mod_base = OTHER; note = 2'-deoxy-2'-fluoro-cytidine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-deoxy-2'-fluoro-guanosine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-deoxy-2'-fluoro-guanosine-3'-phosphorothioate
  modified_base 18: mod_base = OTHER; note = 2'-O-methyl-adenosine-3'-phosphorothioate
  modified_base 19: mod_base = OTHER; note = 2'-O-methyl-adenosine-3'-phosphate
ccgcgccggcagaggggaa

SEQ ID NO: 2434 - RNA, 19 nt, synthetic construct
  source 1..19: mol_type = other RNA
  modified_base 1: mod_base = OTHER; note = 2'-O-methyl-uridine-3'-phosphorothioate
  modified_base 2: mod_base = OTHER; note = 2'-O-methyl-cytidine-3'-phosphorothioate
  modified_base 3: mod_base = OTHER; note = 2'-deoxy-2'-fluoro-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-O-methyl-guanosine-3'-phosphate
  modified_base 7: mod_base = OTHER; note = 2'-deoxy-2'-fluoro-adenosine-3'-phosphate
  modified_base 8: mod_base = OTHER; note = 2'-deoxy-2'-fluoro-uridine-3'-phosphate
  modified_base 9: mod_base = OTHER; note = 2'-deoxy-2'-fluoro-guanosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-deoxy-2'-fluoro-uridine-3'-phosphate
  modified_base 13: mod_base = OTHER; note = 2'-O-methyl-adenosine-3'-phosphate
  modified_base 14: mod_base = OTHER; note = 2'-O-methyl-guanosine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-deoxy-2'-fluoro-cytidine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
tcctggatgattagttcaa

SEQ ID NO: 2435 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-cytidine-3'-phosphorothioate
  modified_base 3: mod_base = OTHER; note = 2'-deoxy-2'-fluoro-uridine-3'-phosphate
  modified_base 4: mod_base = OTHER; note = 2'-O-methyl-guanosine-3'-phosphate
  modified_base 5: mod_base = OTHER; note = 2'-O-methyl-guanosine-3'-phosphate
  modified_base 6: mod_base = OTHER; note = 2'-O-methyl-adenosine-3'-phosphate
  modified_base 7: mod_base = OTHER; note = 2'-deoxy-2'-fluoro-uridine-3'-phosphate
  modified_base 8: mod_base = OTHER; note = 2'-deoxy-2'-fluoro-guanosine-3'-phosphate
  modified_base 9: mod_base = OTHER; note = 2'-deoxy-2'-fluoro-adenosine-3'-phosphate
  modified_base 10: mod_base = OTHER; note = 2'-O-methyl-uridine-3'-phosphate
  modified_base 11: mod_base = OTHER; note = 2'-O-methyl-uridine-3'-phosphate
  modified_base 12: mod_base = OTHER; note = 2'-deoxy-2'-fluoro-adenosine-3'-phosphate
  modified_base 13: mod_base = OTHER; note = 2'-O-methyl-guanosine-3'-phosphate
  modified_base 14: mod_base = OTHER; note = 2'-O-methyl-uridine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-deoxy-2'-fluoro-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphate
cctggatgattagttcaga

SEQ ID NO: 2436 - RNA, 19 nt, synthetic construct
  source 1..19: mol_type = other RNA
  modified_base 1: mod_base = OTHER; note = 2'-O-methyl-cytidine-3'-phosphorothioate
  modified_base 2: mod_base = OTHER; note = 2'-O-methyl-uridine-3'-phosphorothioate
  modified_base 3: mod_base = OTHER; note = 2'-deoxy-2'-fluoro-guanosine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-O-methyl-uridine-3'-phosphate
  modified_base 7: mod_base = OTHER; note = 2'-deoxy-2'-fluoro-guanosine-3'-phosphate
  modified_base 8: mod_base = OTHER; note = 2'-deoxy-2'-fluoro-adenosine-3'-phosphate
  modified_base 9: mod_base = OTHER; note = 2'-deoxy-2'-fluoro-uridine-3'-phosphate
  modified_base 10: mod_base = OTHER; note = 2'-O-methyl-uridine-3'-phosphate
  modified_base 11: mod_base = OTHER; note = 2'-O-methyl-adenosine-3'-phosphate
  modified_base 12: mod_base = OTHER; note = 2'-deoxy-2'-fluoro-guanosine-3'-phosphate
  modified_base 13: mod_base = OTHER; note = 2'-O-methyl-uridine-3'-phosphate
  modified_base 14: mod_base = OTHER; note = 2'-O-methyl-uridine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-deoxy-2'-fluoro-guanosine-3'-phosphate
  modified_base 18: mod_base = OTHER; note = 2'-O-methyl-adenosine-3'-phosphate
  modified_base 19: mod_base = OTHER; note = 2'-O-methyl-adenosine-3'-phosphate
ctggatgattagttcagaa

SEQ ID NO: 2437 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-uridine-3'-phosphate
  modified_base 5: mod_base = OTHER; note = 2'-O-methyl-cytidine-3'-phosphate
  modified_base 6: mod_base = OTHER; note = 2'-O-methyl-guanosine-3'-phosphate
  modified_base 7: mod_base = OTHER; note = 2'-O-methyl-adenosine-3'-phosphate
  modified_base 8: mod_base = OTHER; note = 2'-O-methyl-uridine-3'-phosphate
  modified_base 9: mod_base = OTHER; note = 2'-O-methyl-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-guanosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-adenosine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tcttcgattctgaaaccagtt

SEQ ID NO: 2438 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-adenosine-3'-phosphate
  modified_base 6: mod_base = OTHER; note = 2'-O-methyl-adenosine-3'-phosphate
  modified_base 7: mod_base = OTHER; note = 2'-O-methyl-uridine-3'-phosphate
  modified_base 8: mod_base = OTHER; note = 2'-O-methyl-cytidine-3'-phosphate
  modified_base 9: mod_base = OTHER; note = 2'-O-methyl-cytidine-3'-phosphate
  modified_base 10: mod_base = OTHER; note = 2'-O-methyl-adenosine-3'-phosphate
  modified_base 11: mod_base = OTHER; note = 2'-O-methyl-guanosine-3'-phosphate
  modified_base 12: mod_base = OTHER; note = 2'-O-methyl-guanosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-cytidine-3'-phosphate
  modified_base 19: mod_base = OTHER; note = 2'-O-methyl-uridine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctaatccaggtttgccttt

SEQ ID NO: 2439 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-O-methyl-adenosine-3'-phosphate
  modified_base 7: mod_base = OTHER; note = 2'-O-methyl-adenosine-3'-phosphate
  modified_base 8: mod_base = OTHER; note = 2'-O-methyl-uridine-3'-phosphate
  modified_base 9: mod_base = OTHER; note = 2'-O-methyl-cytidine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-guanosine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-uridine-3'-phosphate
  modified_base 16: mod_base = OTHER; note = 2'-O-methyl-uridine-3'-phosphate
  modified_base 17: mod_base = OTHER; note = 2'-O-methyl-guanosine-3'-phosphate
  modified_base 18: mod_base = OTHER; note = 2'-O-methyl-cytidine-3'-phosphate
  modified_base 19: mod_base = OTHER; note = 2'-O-methyl-cytidine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctctaatccaggtttgcctt

SEQ ID NO: 2440 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-uridine-3'-phosphate
  modified_base 6: mod_base = OTHER; note = 2'-O-methyl-adenosine-3'-phosphate
  modified_base 7: mod_base = OTHER; note = 2'-O-methyl-adenosine-3'-phosphate
  modified_base 8: mod_base = OTHER; note = 2'-O-methyl-cytidine-3'-phosphate
  modified_base 9: mod_base = OTHER; note = 2'-O-methyl-uridine-3'-phosphate
  modified_base 10: mod_base = OTHER; note = 2'-O-methyl-cytidine-3'-phosphate
  modified_base 11: mod_base = OTHER; note = 2'-O-methyl-uridine-3'-phosphate
  modified_base 12: mod_base = OTHER; note = 2'-O-methyl-adenosine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tatgtaactctaatccaggtt

SEQ ID NO: 2441 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-O-methyl-uridine-3'-phosphate
  modified_base 7: mod_base = OTHER; note = 2'-O-methyl-adenosine-3'-phosphate
  modified_base 8: mod_base = OTHER; note = 2'-O-methyl-adenosine-3'-phosphate
  modified_base 9: mod_base = OTHER; note = 2'-O-methyl-cytidine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-uridine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgatgtaactctaatccagtt

SEQ ID NO: 2442 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-adenosine-3'-phosphorothioate
  modified_base 3: mod_base = OTHER; note = 2'-O-methyl-adenosine-3'-phosphate
  modified_base 4: mod_base = OTHER; note = 2'-O-methyl-cytidine-3'-phosphate
  modified_base 5: mod_base = OTHER; note = 2'-O-methyl-uridine-3'-phosphate
  modified_base 6: mod_base = OTHER; note = 2'-O-methyl-adenosine-3'-phosphate
  modified_base 7: mod_base = OTHER; note = 2'-O-methyl-adenosine-3'-phosphate
  modified_base 8: mod_base = OTHER; note = 2'-O-methyl-uridine-3'-phosphate
  modified_base 9: mod_base = OTHER; note = 2'-O-methyl-cytidine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-guanosine-3'-phosphate
  modified_base 16: mod_base = OTHER; note = 2'-O-methyl-guanosine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
taactaatcatccaggagatt

SEQ ID NO: 2443 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-guanosine-3'-phosphorothioate
  modified_base 3: mod_base = OTHER; note = 2'-O-methyl-adenosine-3'-phosphate
  modified_base 4: mod_base = OTHER; note = 2'-O-methyl-adenosine-3'-phosphate
  modified_base 5: mod_base = OTHER; note = 2'-O-methyl-cytidine-3'-phosphate
  modified_base 6: mod_base = OTHER; note = 2'-O-methyl-uridine-3'-phosphate
  modified_base 7: mod_base = OTHER; note = 2'-O-methyl-adenosine-3'-phosphate
  modified_base 8: mod_base = OTHER; note = 2'-O-methyl-adenosine-3'-phosphate
  modified_base 9: mod_base = OTHER; note = 2'-O-methyl-uridine-3'-phosphate
  modified_base 10: mod_base = OTHER; note = 2'-O-methyl-cytidine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-adenosine-3'-phosphate
  modified_base 16: mod_base = OTHER; note = 2'-O-methyl-guanosine-3'-phosphate
  modified_base 17: mod_base = OTHER; note = 2'-O-methyl-guanosine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tgaactaatcatccaggagtt

SEQ ID NO: 2444 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-cytidine-3'-phosphate
  modified_base 5: mod_base = OTHER; note = 2'-O-methyl-cytidine-3'-phosphate
  modified_base 6: mod_base = OTHER; note = 2'-O-methyl-cytidine-3'-phosphate
  modified_base 7: mod_base = OTHER; note = 2'-O-methyl-uridine-3'-phosphate
  modified_base 8: mod_base = OTHER; note = 2'-O-methyl-cytidine-3'-phosphate
  modified_base 9: mod_base = OTHER; note = 2'-O-methyl-uridine-3'-phosphate
  modified_base 10: mod_base = OTHER; note = 2'-O-methyl-guanosine-3'-phosphate
  modified_base 11: mod_base = OTHER; note = 2'-O-methyl-cytidine-3'-phosphate
  modified_base 12: mod_base = OTHER; note = 2'-O-methyl-cytidine-3'-phosphate
  modified_base 13: mod_base = OTHER; note = 2'-O-methyl-guanosine-3'-phosphate
  modified_base 14: mod_base = OTHER; note = 2'-deoxy-2'-fluoro-guanosine-3'-phosphate
  modified_base 15: mod_base = OTHER; note = 2'-O-methyl-cytidine-3'-phosphate
  modified_base 16: mod_base = OTHER; note = 2'-O-methyl-guanosine-3'-phosphate
  modified_base 17: mod_base = OTHER; note = 2'-O-methyl-cytidine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttcccctctgccggcgcggtt

SEQ ID NO: 2445 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-guanosine-3'-phosphate
  modified_base 4: mod_base = OTHER; note = 2'-O-methyl-adenosine-3'-phosphate
  modified_base 5: mod_base = OTHER; note = 2'-O-methyl-adenosine-3'-phosphate
  modified_base 6: mod_base = OTHER; note = 2'-O-methyl-cytidine-3'-phosphate
  modified_base 7: mod_base = OTHER; note = 2'-O-methyl-uridine-3'-phosphate
  modified_base 8: mod_base = OTHER; note = 2'-O-methyl-adenosine-3'-phosphate
  modified_base 9: mod_base = OTHER; note = 2'-O-methyl-adenosine-3'-phosphate
  modified_base 10: mod_base = OTHER; note = 2'-O-methyl-uridine-3'-phosphate
  modified_base 11: mod_base = OTHER; note = 2'-O-methyl-cytidine-3'-phosphate
  modified_base 12: mod_base = OTHER; note = 2'-O-methyl-adenosine-3'-phosphate
  modified_base 13: mod_base = OTHER; note = 2'-O-methyl-uridine-3'-phosphate
  modified_base 14: mod_base = OTHER; note = 2'-deoxy-2'-fluoro-cytidine-3'-phosphate
  modified_base 15: mod_base = OTHER; note = 2'-O-methyl-cytidine-3'-phosphate
  modified_base 16: mod_base = OTHER; note = 2'-O-methyl-adenosine-3'-phosphate
  modified_base 17: mod_base = OTHER; note = 2'-O-methyl-guanosine-3'-phosphate
  modified_base 18: mod_base = OTHER; note = 2'-O-methyl-guanosine-3'-phosphate
  modified_base 19: mod_base = OTHER; note = 2'-O-methyl-adenosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttgaactaatcatccaggatt

SEQ ID NO: 2446 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-cytidine-3'-phosphorothioate
  modified_base 3: mod_base = OTHER; note = 2'-O-methyl-uridine-3'-phosphate
  modified_base 4: mod_base = OTHER; note = 2'-O-methyl-guanosine-3'-phosphate
  modified_base 5: mod_base = OTHER; note = 2'-O-methyl-adenosine-3'-phosphate
  modified_base 6: mod_base = OTHER; note = 2'-O-methyl-adenosine-3'-phosphate
  modified_base 7: mod_base = OTHER; note = 2'-O-methyl-cytidine-3'-phosphate
  modified_base 8: mod_base = OTHER; note = 2'-O-methyl-uridine-3'-phosphate
  modified_base 9: mod_base = OTHER; note = 2'-O-methyl-adenosine-3'-phosphate
  modified_base 10: mod_base = OTHER; note = 2'-O-methyl-adenosine-3'-phosphate
  modified_base 11: mod_base = OTHER; note = 2'-O-methyl-uridine-3'-phosphate
  modified_base 12: mod_base = OTHER; note = 2'-O-methyl-cytidine-3'-phosphate
  modified_base 13: mod_base = OTHER; note = 2'-O-methyl-adenosine-3'-phosphate
  modified_base 14: mod_base = OTHER; note = 2'-deoxy-2'-fluoro-uridine-3'-phosphate
  modified_base 15: mod_base = OTHER; note = 2'-O-methyl-cytidine-3'-phosphate
  modified_base 16: mod_base = OTHER; note = 2'-O-methyl-cytidine-3'-phosphate
  modified_base 17: mod_base = OTHER; note = 2'-O-methyl-adenosine-3'-phosphate
  modified_base 18: mod_base = OTHER; note = 2'-O-methyl-guanosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
tctgaactaatcatccaggtt

SEQ ID NO: 2447 - RNA, 21 nt, synthetic construct
  source 1..21: mol_type = other RNA
  modified_base 1: mod_base = OTHER; note 5'-vinylphosphonate-2'-O-methyl-uridine-3'-phosphorothioate
  modified_base 2: mod_base = OTHER; note = 2'-deoxy-2'-fluoro-uridine-3'-phosphorothioate
  modified_base 3: mod_base = OTHER; note = 2'-O-methyl-cytidine-3'-phosphate
  modified_base 4: mod_base = OTHER; note = 2'-O-methyl-uridine-3'-phosphate
  modified_base 5: mod_base = OTHER; note = 2'-O-methyl-guanosine-3'-phosphate
  modified_base 6: mod_base = OTHER; note = 2'-O-methyl-adenosine-3'-phosphate
  modified_base 7: mod_base = OTHER; note = 2'-O-methyl-adenosine-3'-phosphate
  modified_base 8: mod_base = OTHER; note = 2'-O-methyl-cytidine-3'-phosphate
  modified_base 9: mod_base = OTHER; note = 2'-O-methyl-uridine-3'-phosphate
  modified_base 10: mod_base = OTHER; note = 2'-O-methyl-adenosine-3'-phosphate
  modified_base 11: mod_base = OTHER; note = 2'-O-methyl-adenosine-3'-phosphate
  modified_base 12: mod_base = OTHER; note = 2'-O-methyl-uridine-3'-phosphate
  modified_base 13: mod_base = OTHER; note = 2'-O-methyl-cytidine-3'-phosphate
  modified_base 14: mod_base = OTHER; note = 2'-deoxy-2'-fluoro-adenosine-3'-phosphate
  modified_base 15: mod_base = OTHER; note = 2'-O-methyl-uridine-3'-phosphate
  modified_base 16: mod_base = OTHER; note = 2'-O-methyl-cytidine-3'-phosphate
  modified_base 17: mod_base = OTHER; note = 2'-O-methyl-cytidine-3'-phosphate
  modified_base 18: mod_base = OTHER; note = 2'-O-methyl-adenosine-3'-phosphate
  modified_base 19: mod_base = OTHER; note = 2'-O-methyl-guanosine-3'-phosphorothioate
  modified_base 20: mod_base = OTHER; note = 2'-O-methyl-uridine-3'-phosphorothioate
  modified_base 21: mod_base = OTHER; note = 2'-O-methyl-uridine-3'-phosphate
ttctgaactaatcatccagtt

SEQ ID NO: 2448 - RNA, 19 nt, synthetic construct
  source 1..19: mol_type = other RNA
atggccctcccgacaccct

SEQ ID NO: 2449 - RNA, 19 nt, synthetic construct
  source 1..19: mol_type = other RNA
tggccctcccgacaccctc

SEQ ID NO: 2450 - RNA, 19 nt, synthetic construct
  source 1..19: mol_type = other RNA
cgacaccctcggacagcac

SEQ ID NO: 2451 - RNA, 19 nt, synthetic construct
  source 1..19: mol_type = other RNA
gacaccctcggacagcacc

SEQ ID NO: 2452 - RNA, 19 nt, synthetic construct
  source 1..19: mol_type = other RNA
acaccctcggacagcaccc

SEQ ID NO: 2453 - RNA, 19 nt, synthetic construct
  source 1..19: mol_type = other RNA
caccctcggacagcaccct

SEQ ID NO: 2454 - RNA, 19 nt, synthetic construct
  source 1..19: mol_type = other RNA
accctcggacagcaccctc

SEQ ID NO: 2455 - RNA, 19 nt, synthetic construct
  source 1..19: mol_type = other RNA
ccctcggacagcaccctcc

SEQ ID NO: 2456 - RNA, 19 nt, synthetic construct
  source 1..19: mol_type = other RNA
cctcggacagcaccctccc

SEQ ID NO: 2457 - RNA, 19 nt, synthetic construct
  source 1..19: mol_type = other RNA
ctcggacagcaccctcccc

SEQ ID NO: 2458 - RNA, 19 nt, synthetic construct
  source 1..19: mol_type = other RNA
tcggacagcaccctccccg

SEQ ID NO: 2459 - RNA, 19 nt, synthetic construct
  source 1..19: mol_type = other RNA
acagcaccctccccgcgga

SEQ ID NO: 2460 - RNA, 19 nt, synthetic construct
  source 1..19: mol_type = other RNA
cagcaccctccccgcggaa

SEQ ID NO: 2461 - RNA, 19 nt, synthetic construct
  source 1..19: mol_type = other RNA
agcaccctccccgcggaag

SEQ ID NO: 2462 - RNA, 19 nt, synthetic construct
  source 1..19: mol_type = other RNA
gaggacggcgacggagact

SEQ ID NO: 2463 - RNA, 19 nt, synthetic construct
  source 1..19: mol_type = other RNA
aggacggcgacggagactc

SEQ ID NO: 2464 - RNA, 19 nt, synthetic construct
  source 1..19: mol_type = other RNA
ggacggcgacggagactcg

SEQ ID NO: 2465 - RNA, 19 nt, synthetic construct
  source 1..19: mol_type = other RNA
gacggcgacggagactcgt

SEQ ID NO: 2466 - RNA, 19 nt, synthetic construct
  source 1..19: mol_type = other RNA
acggcgacggagactcgtt

SEQ ID NO: 2467 - RNA, 19 nt, synthetic construct
  source 1..19: mol_type = other RNA
gcgacggagactcgtttgg

SEQ ID NO: 2468 - RNA, 19 nt, synthetic construct
  source 1..19: mol_type = other RNA
cgacggagactcgtttgga

SEQ ID NO: 2469 - RNA, 19 nt, synthetic construct
  source 1..19: mol_type = other RNA
gacggagactcgtttggac

SEQ ID NO: 2470 - RNA, 19 nt, synthetic construct
  source 1..19: mol_type = other RNA
acggagactcgtttggacc

SEQ ID NO: 2471 - RNA, 19 nt, synthetic construct
  source 1..19: mol_type = other RNA
cggagactcgtttggaccc

SEQ ID NO: 2472 - RNA, 19 nt, synthetic construct
  source 1..19: mol_type = other RNA
ggagactcgtttggacccc

SEQ ID NO: 2473 - RNA, 19 nt, synthetic construct
  source 1..19: mol_type = other RNA
gagactcgtttggaccccg

SEQ ID NO: 2474 - RNA, 19 nt, synthetic construct
  source 1..19: mol_type = other RNA
agactcgtttggaccccga

SEQ ID NO: 2475 - RNA, 19 nt, synthetic construct
  source 1..19: mol_type = other RNA
tcgtttggaccccgagcca

SEQ ID NO: 2476 - RNA, 19 nt, synthetic construct
  source 1..19: mol_type = other RNA
tggaccccgagccaaagcg

SEQ ID NO: 2477 - RNA, 19 nt, synthetic construct
  source 1..19: mol_type = other RNA
cgagccaaagcgaggccct

SEQ ID NO: 2478 - RNA, 19 nt, synthetic construct
  source 1..19: mol_type = other RNA
gagccaaagcgaggccctg

SEQ ID NO: 2479 - RNA, 19 nt, synthetic construct
  source 1..19: mol_type = other RNA
agccaaagcgaggccctgc

SEQ ID NO: 2480 - RNA, 19 nt, synthetic construct
  source 1..19: mol_type = other RNA
gccaaagcgaggccctgcg

SEQ ID NO: 2481 - RNA, 19 nt, synthetic construct
  source 1..19: mol_type = other RNA
ccaaagcgaggccctgcga

SEQ ID NO: 2482 - RNA, 19 nt, synthetic construct
  source 1..19: mol_type = other RNA
caaagcgaggccctgcgag

SEQ ID NO: 2483 - RNA, 19 nt, synthetic construct
  source 1..19: mol_type = other RNA
aaagcgaggccctgcgagc

SEQ ID NO: 2484 - RNA, 19 nt, synthetic construct
  source 1..19: mol_type = other RNA
aagcgaggccctgcgagcc

SEQ ID NO: 2485 - RNA, 19 nt, synthetic construct
  source 1..19: mol_type = other RNA
ctgctttgagcggaacccg

SEQ ID NO: 2486 - RNA, 19 nt, synthetic construct
  source 1..19: mol_type = other RNA
tgctttgagcggaacccgt

SEQ ID NO: 2487 - RNA, 19 nt, synthetic construct
  source 1..19: mol_type = other RNA
gctttgagcggaacccgta

SEQ ID NO: 2488 - RNA, 19 nt, synthetic construct
  source 1..19: mol_type = other RNA
ctttgagcggaacccgtac

SEQ ID NO: 2489 - RNA, 19 nt, synthetic construct
  source 1..19: mol_type = other RNA
tttgagcggaacccgtacc

SEQ ID NO: 2490 - RNA, 19 nt, synthetic construct
  source 1..19: mol_type = other RNA
ttgagcggaacccgtaccc

SEQ ID NO: 2491 - RNA, 19 nt, synthetic construct
  source 1..19: mol_type = other RNA
tgagcggaacccgtacccg

SEQ ID NO: 2492 - RNA, 19 nt, synthetic construct
  source 1..19: mol_type = other RNA
gagcggaacccgtacccgg

SEQ ID NO: 2493 - RNA, 19 nt, synthetic construct
  source 1..19: mol_type = other RNA
agcggaacccgtacccggg

SEQ ID NO: 2494 - RNA, 19 nt, synthetic construct
  source 1..19: mol_type = other RNA
ccgtacccgggcatcgcca

SEQ ID NO: 2495 - RNA, 19 nt, synthetic construct
  source 1..19: mol_type = other RNA
cgtacccgggcatcgccac

SEQ ID NO: 2496 - RNA, 19 nt, synthetic construct
  source 1..19: mol_type = other RNA
gtacccgggcatcgccacc

SEQ ID NO: 2497 - RNA, 19 nt, synthetic construct
  source 1..19: mol_type = other RNA
tacccgggcatcgccacca

SEQ ID NO: 2498 - RNA, 19 nt, synthetic construct
  source 1..19: mol_type = other RNA
cccgggcatcgccaccaga

SEQ ID NO: 2499 - RNA, 19 nt, synthetic construct
  source 1..19: mol_type = other RNA
ccgggcatcgccaccagag

SEQ ID NO: 2500 - RNA, 19 nt, synthetic construct
  source 1..19: mol_type = other RNA
cgggcatcgccaccagaga

SEQ ID NO: 2501 - RNA, 19 nt, synthetic construct
  source 1..19: mol_type = other RNA
gggcatcgccaccagagaa

SEQ ID NO: 2502 - RNA, 19 nt, synthetic construct
  source 1..19: mol_type = other RNA
ggcatcgccaccagagaac

SEQ ID NO: 2503 - RNA, 19 nt, synthetic construct
  source 1..19: mol_type = other RNA
gcatcgccaccagagaacg

SEQ ID NO: 2504 - RNA, 19 nt, synthetic construct
  source 1..19: mol_type = other RNA
catcgccaccagagaacgg

SEQ ID NO: 2505 - RNA, 19 nt, synthetic construct
  source 1..19: mol_type = other RNA
atcgccaccagagaacggc

SEQ ID NO: 2506 - RNA, 19 nt, synthetic construct
  source 1..19: mol_type = other RNA
tcgccaccagagaacggct

SEQ ID NO: 2507 - RNA, 19 nt, synthetic construct
  source 1..19: mol_type = other RNA
cgccaccagagaacggctg

SEQ ID NO: 2508 - RNA, 19 nt, synthetic construct
  source 1..19: mol_type = other RNA
cagagaacggctggcccag

SEQ ID NO: 2509 - RNA, 19 nt, synthetic construct
  source 1..19: mol_type = other RNA
agagaacggctggcccagg

SEQ ID NO: 2510 - RNA, 19 nt, synthetic construct
  source 1..19: mol_type = other RNA
gagaacggctggcccaggc

SEQ ID NO: 2511 - RNA, 19 nt, synthetic construct
  source 1..19: mol_type = other RNA
agaacggctggcccaggcc

SEQ ID NO: 2512 - RNA, 19 nt, synthetic construct
  source 1..19: mol_type = other RNA
gaacggctggcccaggcca

SEQ ID NO: 2513 - RNA, 19 nt, synthetic construct
  source 1..19: mol_type = other RNA
gcccaggccatcggcattc

SEQ ID NO: 2514 - RNA, 19 nt, synthetic construct
  source 1..19: mol_type = other RNA
cccaggccatcggcattcc

SEQ ID NO: 2515 - RNA, 19 nt, synthetic construct
  source 1..19: mol_type = other RNA
ccaggccatcggcattccg

SEQ ID NO: 2516 - RNA, 19 nt, synthetic construct
  source 1..19: mol_type = other RNA
caggccatcggcattccgg

SEQ ID NO: 2517 - RNA, 19 nt, synthetic construct
  source 1..19: mol_type = other RNA
aggccatcggcattccgga

SEQ ID NO: 2518 - RNA, 19 nt, synthetic construct
  source 1..19: mol_type = other RNA
ggccatcggcattccggag

SEQ ID NO: 2519 - RNA, 19 nt, synthetic construct
  source 1..19: mol_type = other RNA
gccatcggcattccggagc

SEQ ID NO: 2520 - RNA, 19 nt, synthetic construct
  source 1..19: mol_type = other RNA
ccatcggcattccggagcc

SEQ ID NO: 2521 - RNA, 19 nt, synthetic construct
  source 1..19: mol_type = other RNA
catcggcattccggagccc

SEQ ID NO: 2522 - RNA, 19 nt, synthetic construct
  source 1..19: mol_type = other RNA
atcggcattccggagccca

SEQ ID NO: 2523 - RNA, 19 nt, synthetic construct
  source 1..19: mol_type = other RNA
tcggcattccggagcccag

SEQ ID NO: 2524 - RNA, 19 nt, synthetic construct
  source 1..19: mol_type = other RNA
cggcattccggagcccagg

SEQ ID NO: 2525 - RNA, 19 nt, synthetic construct
  source 1..19: mol_type = other RNA
ggcattccggagcccaggg

SEQ ID NO: 2526 - RNA, 19 nt, synthetic construct
  source 1..19: mol_type = other RNA
gcattccggagcccagggt

SEQ ID NO: 2527 - RNA, 19 nt, synthetic construct
  source 1..19: mol_type = other RNA
cattccggagcccagggtc

SEQ ID NO: 2528 - RNA, 19 nt, synthetic construct
  source 1..19: mol_type = other RNA
attccggagcccagggtcc

SEQ ID NO: 2529 - RNA, 19 nt, synthetic construct
  source 1..19: mol_type = other RNA
ttccggagcccagggtcca

SEQ ID NO: 2530 - RNA, 19 nt, synthetic construct
  source 1..19: mol_type = other RNA
tccggagcccagggtccag

SEQ ID NO: 2531 - RNA, 19 nt, synthetic construct
  source 1..19: mol_type = other RNA
ccggagcccagggtccaga

SEQ ID NO: 2532 - RNA, 19 nt, synthetic construct
  source 1..19: mol_type = other RNA
cggagcccagggtccagat

SEQ ID NO: 2533 - RNA, 19 nt, synthetic construct
  source 1..19: mol_type = other RNA
ggagcccagggtccagatt

SEQ ID NO: 2534 - RNA, 19 nt, synthetic construct
  source 1..19: mol_type = other RNA
ggtccagatttggtttcag

SEQ ID NO: 2535 - RNA, 19 nt, synthetic construct
  source 1..19: mol_type = other RNA
gtccagatttggtttcaga

SEQ ID NO: 2536 - RNA, 19 nt, synthetic construct
  source 1..19: mol_type = other RNA
tccagatttggtttcagaa

SEQ ID NO: 2537 - RNA, 19 nt, synthetic construct
  source 1..19: mol_type = other RNA
ccagatttggtttcagaat

SEQ ID NO: 2538 - RNA, 19 nt, synthetic construct
  source 1..19: mol_type = other RNA
cagatttggtttcagaatg

SEQ ID NO: 2539 - RNA, 19 nt, synthetic construct
  source 1..19: mol_type = other RNA
gatttggtttcagaatgag

SEQ ID NO: 2540 - RNA, 19 nt, synthetic construct
  source 1..19: mol_type = other RNA
tttggtttcagaatgagag

SEQ ID NO: 2541 - RNA, 19 nt, synthetic construct
  source 1..19: mol_type = other RNA
ttggtttcagaatgagagg

SEQ ID NO: 2542 - RNA, 19 nt, synthetic construct
  source 1..19: mol_type = other RNA
tggtttcagaatgagaggt

SEQ ID NO: 2543 - RNA, 19 nt, synthetic construct
  source 1..19: mol_type = other RNA
ggtttcagaatgagaggtc

SEQ ID NO: 2544 - RNA, 19 nt, synthetic construct
  source 1..19: mol_type = other RNA
gtttcagaatgagaggtca

SEQ ID NO: 2545 - RNA, 19 nt, synthetic construct
  source 1..19: mol_type = other RNA
tttcagaatgagaggtcac

SEQ ID NO: 2546 - RNA, 19 nt, synthetic construct
  source 1..19: mol_type = other RNA
ttcagaatgagaggtcacg

SEQ ID NO: 2547 - RNA, 19 nt, synthetic construct
  source 1..19: mol_type = other RNA
tcagaatgagaggtcacgc

SEQ ID NO: 2548 - RNA, 19 nt, synthetic construct
  source 1..19: mol_type = other RNA
cagaatgagaggtcacgcc

SEQ ID NO: 2549 - RNA, 19 nt, synthetic construct
  source 1..19: mol_type = other RNA
agaatgagaggtcacgcca

SEQ ID NO: 2550 - RNA, 19 nt, synthetic construct
  source 1..19: mol_type = other RNA
gaatgagaggtcacgccag

SEQ ID NO: 2551 - RNA, 19 nt, synthetic construct
  source 1..19: mol_type = other RNA
aatgagaggtcacgccagc

SEQ ID NO: 2552 - RNA, 19 nt, synthetic construct
  source 1..19: mol_type = other RNA
atgagaggtcacgccagct

SEQ ID NO: 2553 - RNA, 19 nt, synthetic construct
  source 1..19: mol_type = other RNA
tgagaggtcacgccagctg

SEQ ID NO: 2554 - RNA, 19 nt, synthetic construct
  source 1..19: mol_type = other RNA
gagaggtcacgccagctga

SEQ ID NO: 2555 - RNA, 19 nt, synthetic construct
  source 1..19: mol_type = other RNA
agaggtcacgccagctgag

SEQ ID NO: 2556 - RNA, 19 nt, synthetic construct
  source 1..19: mol_type = other RNA
gaggtcacgccagctgagg

SEQ ID NO: 2557 - RNA, 19 nt, synthetic construct
  source 1..19: mol_type = other RNA
aggtcacgccagctgaggc

SEQ ID NO: 2558 - RNA, 19 nt, synthetic construct
  source 1..19: mol_type = other RNA
ggtcacgccagctgaggca

SEQ ID NO: 2559 - RNA, 19 nt, synthetic construct
  source 1..19: mol_type = other RNA
gtcacgccagctgaggcag

SEQ ID NO: 2560 - RNA, 19 nt, synthetic construct
  source 1..19: mol_type = other RNA
tcacgccagctgaggcagc

SEQ ID NO: 2561 - RNA, 19 nt, synthetic construct
  source 1..19: mol_type = other RNA
cacgccagctgaggcagca

SEQ ID NO: 2562 - RNA, 19 nt, synthetic construct
  source 1..19: mol_type = other RNA
tgaggcagcaccggcggga

SEQ ID NO: 2563 - RNA, 19 nt, synthetic construct
  source 1..19: mol_type = other RNA
aggcagcaccggcgggaat

SEQ ID NO: 2564 - RNA, 19 nt, synthetic construct
  source 1..19: mol_type = other RNA
ggcagcaccggcgggaatc

SEQ ID NO: 2565 - RNA, 19 nt, synthetic construct
  source 1..19: mol_type = other RNA
gcagcaccggcgggaatct

SEQ ID NO: 2566 - RNA, 19 nt, synthetic construct
  source 1..19: mol_type = other RNA
cagcaccggcgggaatctc

SEQ ID NO: 2567 - RNA, 19 nt, synthetic construct
  source 1..19: mol_type = other RNA
agcaccggcgggaatctcg

SEQ ID NO: 2568 - RNA, 19 nt, synthetic construct
  source 1..19: mol_type = other RNA
gcaccggcgggaatctcgg

SEQ ID NO: 2569 - RNA, 19 nt, synthetic construct
  source 1..19: mol_type = other RNA
caccggcgggaatctcggc

SEQ ID NO: 2570 - RNA, 19 nt, synthetic construct
  source 1..19: mol_type = other RNA
cggcgggaatctcggccct

SEQ ID NO: 2571 - RNA, 19 nt, synthetic construct
  source 1..19: mol_type = other RNA
ggcgggaatctcggccctg

SEQ ID NO: 2572 - RNA, 19 nt, synthetic construct
  source 1..19: mol_type = other RNA
gcgggaatctcggccctgg

SEQ ID NO: 2573 - RNA, 19 nt, synthetic construct
  source 1..19: mol_type = other RNA
cgggaatctcggccctggc

SEQ ID NO: 2574 - RNA, 19 nt, synthetic construct
  source 1..19: mol_type = other RNA
gggaatctcggccctggcc

SEQ ID NO: 2575 - RNA, 19 nt, synthetic construct
  source 1..19: mol_type = other RNA
ggaatctcggccctggccc

SEQ ID NO: 2576 - RNA, 19 nt, synthetic construct
  source 1..19: mol_type = other RNA
gaatctcggccctggcccg

SEQ ID NO: 2577 - RNA, 19 nt, synthetic construct
  source 1..19: mol_type = other RNA
gcgaaagcggaccgccgtc

SEQ ID NO: 2578 - RNA, 19 nt, synthetic construct
  source 1..19: mol_type = other RNA
cgaaagcggaccgccgtca

SEQ ID NO: 2579 - RNA, 19 nt, synthetic construct
  source 1..19: mol_type = other RNA
gaaagcggaccgccgtcac

SEQ ID NO: 2580 - RNA, 19 nt, synthetic construct
  source 1..19: mol_type = other RNA
aaagcggaccgccgtcacc

SEQ ID NO: 2581 - RNA, 19 nt, synthetic construct
  source 1..19: mol_type = other RNA
aagcggaccgccgtcaccg

SEQ ID NO: 2582 - RNA, 19 nt, synthetic construct
  source 1..19: mol_type = other RNA
cggaccgccgtcaccggat

SEQ ID NO: 2583 - RNA, 19 nt, synthetic construct
  source 1..19: mol_type = other RNA
ggaccgccgtcaccggatc

SEQ ID NO: 2584 - RNA, 19 nt, synthetic construct
  source 1..19: mol_type = other RNA
gaccgccgtcaccggatcc

SEQ ID NO: 2585 - RNA, 19 nt, synthetic construct
  source 1..19: mol_type = other RNA
accgccgtcaccggatccc

SEQ ID NO: 2586 - RNA, 19 nt, synthetic construct
  source 1..19: mol_type = other RNA
ccgccgtcaccggatccca

SEQ ID NO: 2587 - RNA, 19 nt, synthetic construct
  source 1..19: mol_type = other RNA
cgccgtcaccggatcccag

SEQ ID NO: 2588 - RNA, 19 nt, synthetic construct
  source 1..19: mol_type = other RNA
gccgtcaccggatcccaga

SEQ ID NO: 2589 - RNA, 19 nt, synthetic construct
  source 1..19: mol_type = other RNA
ccgtcaccggatcccagac

SEQ ID NO: 2590 - RNA, 19 nt, synthetic construct
  source 1..19: mol_type = other RNA
cgtcaccggatcccagacc

SEQ ID NO: 2591 - RNA, 19 nt, synthetic construct
  source 1..19: mol_type = other RNA
gtcaccggatcccagaccg

SEQ ID NO: 2592 - RNA, 19 nt, synthetic construct
  source 1..19: mol_type = other RNA
tcaccggatcccagaccgc

SEQ ID NO: 2593 - RNA, 19 nt, synthetic construct
  source 1..19: mol_type = other RNA
caccggatcccagaccgcc

SEQ ID NO: 2594 - RNA, 19 nt, synthetic construct
  source 1..19: mol_type = other RNA
accggatcccagaccgccc

SEQ ID NO: 2595 - RNA, 19 nt, synthetic construct
  source 1..19: mol_type = other RNA
ccggatcccagaccgccct

SEQ ID NO: 2596 - RNA, 19 nt, synthetic construct
  source 1..19: mol_type = other RNA
cggatcccagaccgccctg

SEQ ID NO: 2597 - RNA, 19 nt, synthetic construct
  source 1..19: mol_type = other RNA
ggatcccagaccgccctgc

SEQ ID NO: 2598 - RNA, 19 nt, synthetic construct
  source 1..19: mol_type = other RNA
gatcccagaccgccctgct

SEQ ID NO: 2599 - RNA, 19 nt, synthetic construct
  source 1..19: mol_type = other RNA
atcccagaccgccctgctc

SEQ ID NO: 2600 - RNA, 19 nt, synthetic construct
  source 1..19: mol_type = other RNA
tcccagaccgccctgctcc

SEQ ID NO: 2601 - RNA, 19 nt, synthetic construct
  source 1..19: mol_type = other RNA
cccagaccgccctgctcct

SEQ ID NO: 2602 - RNA, 19 nt, synthetic construct
  source 1..19: mol_type = other RNA
ccagaccgccctgctcctc

SEQ ID NO: 2603 - RNA, 19 nt, synthetic construct
  source 1..19: mol_type = other RNA
cagaccgccctgctcctcc

SEQ ID NO: 2604 - RNA, 19 nt, synthetic construct
  source 1..19: mol_type = other RNA
agaccgccctgctcctccg

SEQ ID NO: 2605 - RNA, 19 nt, synthetic construct
  source 1..19: mol_type = other RNA
gaccgccctgctcctccga

SEQ ID NO: 2606 - RNA, 19 nt, synthetic construct
  source 1..19: mol_type = other RNA
accgccctgctcctccgag

SEQ ID NO: 2607 - RNA, 19 nt, synthetic construct
  source 1..19: mol_type = other RNA
ctcctccgagcctttgaga

SEQ ID NO: 2608 - RNA, 19 nt, synthetic construct
  source 1..19: mol_type = other RNA
ctccgagcctttgagaagg

SEQ ID NO: 2609 - RNA, 19 nt, synthetic construct
  source 1..19: mol_type = other RNA
ctttgagaaggatcgcttt

SEQ ID NO: 2610 - RNA, 19 nt, synthetic construct
  source 1..19: mol_type = other RNA
tttgagaaggatcgctttc

SEQ ID NO: 2611 - RNA, 19 nt, synthetic construct
  source 1..19: mol_type = other RNA
ttgagaaggatcgctttcc

SEQ ID NO: 2612 - RNA, 19 nt, synthetic construct
  source 1..19: mol_type = other RNA
tgagaaggatcgctttcca

SEQ ID NO: 2613 - RNA, 19 nt, synthetic construct
  source 1..19: mol_type = other RNA
gagaaggatcgctttccag

SEQ ID NO: 2614 - RNA, 19 nt, synthetic construct
  source 1..19: mol_type = other RNA
agaaggatcgctttccagg

SEQ ID NO: 2615 - RNA, 19 nt, synthetic construct
  source 1..19: mol_type = other RNA
gaaggatcgctttccaggc

SEQ ID NO: 2616 - RNA, 19 nt, synthetic construct
  source 1..19: mol_type = other RNA
aaggatcgctttccaggca

SEQ ID NO: 2617 - RNA, 19 nt, synthetic construct
  source 1..19: mol_type = other RNA
aggatcgctttccaggcat

SEQ ID NO: 2618 - RNA, 19 nt, synthetic construct
  source 1..19: mol_type = other RNA
ggatcgctttccaggcatc

SEQ ID NO: 2619 - RNA, 19 nt, synthetic construct
  source 1..19: mol_type = other RNA
gatcgctttccaggcatcg

SEQ ID NO: 2620 - RNA, 19 nt, synthetic construct
  source 1..19: mol_type = other RNA
atcgctttccaggcatcgc

SEQ ID NO: 2621 - RNA, 19 nt, synthetic construct
  source 1..19: mol_type = other RNA
tcgctttccaggcatcgcc

SEQ ID NO: 2622 - RNA, 19 nt, synthetic construct
  source 1..19: mol_type = other RNA
cgctttccaggcatcgccg

SEQ ID NO: 2623 - RNA, 19 nt, synthetic construct
  source 1..19: mol_type = other RNA
gctttccaggcatcgccgc

SEQ ID NO: 2624 - RNA, 19 nt, synthetic construct
  source 1..19: mol_type = other RNA
ctttccaggcatcgccgcc

SEQ ID NO: 2625 - RNA, 19 nt, synthetic construct
  source 1..19: mol_type = other RNA
tttccaggcatcgccgccc

SEQ ID NO: 2626 - RNA, 19 nt, synthetic construct
  source 1..19: mol_type = other RNA
ttccaggcatcgccgcccg

SEQ ID NO: 2627 - RNA, 19 nt, synthetic construct
  source 1..19: mol_type = other RNA
ccgggaggagctggccaga

SEQ ID NO: 2628 - RNA, 19 nt, synthetic construct
  source 1..19: mol_type = other RNA
cgggaggagctggccagag

SEQ ID NO: 2629 - RNA, 19 nt, synthetic construct
  source 1..19: mol_type = other RNA
gggaggagctggccagaga

SEQ ID NO: 2630 - RNA, 19 nt, synthetic construct
  source 1..19: mol_type = other RNA
ggaggagctggccagagag

SEQ ID NO: 2631 - RNA, 19 nt, synthetic construct
  source 1..19: mol_type = other RNA
gaggagctggccagagaga

SEQ ID NO: 2632 - RNA, 19 nt, synthetic construct
  source 1..19: mol_type = other RNA
aggagctggccagagagac

SEQ ID NO: 2633 - RNA, 19 nt, synthetic construct
  source 1..19: mol_type = other RNA
ggagctggccagagagacg

SEQ ID NO: 2634 - RNA, 19 nt, synthetic construct
  source 1..19: mol_type = other RNA
gagctggccagagagacgg

SEQ ID NO: 2635 - RNA, 19 nt, synthetic construct
  source 1..19: mol_type = other RNA
agctggccagagagacggg

SEQ ID NO: 2636 - RNA, 19 nt, synthetic construct
  source 1..19: mol_type = other RNA
gctggccagagagacgggc

SEQ ID NO: 2637 - RNA, 19 nt, synthetic construct
  source 1..19: mol_type = other RNA
gccagagagacgggcctcc

SEQ ID NO: 2638 - RNA, 19 nt, synthetic construct
  source 1..19: mol_type = other RNA
ccagagagacgggcctccc

SEQ ID NO: 2639 - RNA, 19 nt, synthetic construct
  source 1..19: mol_type = other RNA
cagagagacgggcctcccg

SEQ ID NO: 2640 - RNA, 19 nt, synthetic construct
  source 1..19: mol_type = other RNA
agagagacgggcctcccgg

SEQ ID NO: 2641 - RNA, 19 nt, synthetic construct
  source 1..19: mol_type = other RNA
ggcctcccggagtccagga

SEQ ID NO: 2642 - RNA, 19 nt, synthetic construct
  source 1..19: mol_type = other RNA
gcctcccggagtccaggat

SEQ ID NO: 2643 - RNA, 19 nt, synthetic construct
  source 1..19: mol_type = other RNA
cctcccggagtccaggatt

SEQ ID NO: 2644 - RNA, 19 nt, synthetic construct
  source 1..19: mol_type = other RNA
ctcccggagtccaggattc

SEQ ID NO: 2645 - RNA, 19 nt, synthetic construct
  source 1..19: mol_type = other RNA
tcccggagtccaggattca

SEQ ID NO: 2646 - RNA, 19 nt, synthetic construct
  source 1..19: mol_type = other RNA
cccggagtccaggattcag

SEQ ID NO: 2647 - RNA, 19 nt, synthetic construct
  source 1..19: mol_type = other RNA
ccggagtccaggattcaga

SEQ ID NO: 2648 - RNA, 19 nt, synthetic construct
  source 1..19: mol_type = other RNA
cggagtccaggattcagat

SEQ ID NO: 2649 - RNA, 19 nt, synthetic construct
  source 1..19: mol_type = other RNA
ggagtccaggattcagatc

SEQ ID NO: 2650 - RNA, 19 nt, synthetic construct
  source 1..19: mol_type = other RNA
gagtccaggattcagatct

SEQ ID NO: 2651 - RNA, 19 nt, synthetic construct
  source 1..19: mol_type = other RNA
agtccaggattcagatctg

SEQ ID NO: 2652 - RNA, 19 nt, synthetic construct
  source 1..19: mol_type = other RNA
caggattcagatctggttt

SEQ ID NO: 2653 - RNA, 19 nt, synthetic construct
  source 1..19: mol_type = other RNA
aggattcagatctggtttc

SEQ ID NO: 2654 - RNA, 19 nt, synthetic construct
  source 1..19: mol_type = other RNA
ggattcagatctggtttca

SEQ ID NO: 2655 - RNA, 19 nt, synthetic construct
  source 1..19: mol_type = other RNA
gattcagatctggtttcag

SEQ ID NO: 2656 - RNA, 19 nt, synthetic construct
  source 1..19: mol_type = other RNA
attcagatctggtttcaga

SEQ ID NO: 2657 - RNA, 19 nt, synthetic construct
  source 1..19: mol_type = other RNA
ctggtttcagaatcgaagg

SEQ ID NO: 2658 - RNA, 19 nt, synthetic construct
  source 1..19: mol_type = other RNA
tggtttcagaatcgaaggg

SEQ ID NO: 2659 - RNA, 19 nt, synthetic construct
  source 1..19: mol_type = other RNA
ggtttcagaatcgaagggc

SEQ ID NO: 2660 - RNA, 19 nt, synthetic construct
  source 1..19: mol_type = other RNA
gtttcagaatcgaagggcc

SEQ ID NO: 2661 - RNA, 19 nt, synthetic construct
  source 1..19: mol_type = other RNA
tttcagaatcgaagggcca

SEQ ID NO: 2662 - RNA, 19 nt, synthetic construct
  source 1..19: mol_type = other RNA
ttcagaatcgaagggccag

SEQ ID NO: 2663 - RNA, 19 nt, synthetic construct
  source 1..19: mol_type = other RNA
tcagaatcgaagggccagg

SEQ ID NO: 2664 - RNA, 19 nt, synthetic construct
  source 1..19: mol_type = other RNA
cagaatcgaagggccaggc

SEQ ID NO: 2665 - RNA, 19 nt, synthetic construct
  source 1..19: mol_type = other RNA
agaatcgaagggccaggca

SEQ ID NO: 2666 - RNA, 19 nt, synthetic construct
  source 1..19: mol_type = other RNA
gaatcgaagggccaggcac

SEQ ID NO: 2667 - RNA, 19 nt, synthetic construct
  source 1..19: mol_type = other RNA
aatcgaagggccaggcacc

SEQ ID NO: 2668 - RNA, 19 nt, synthetic construct
  source 1..19: mol_type = other RNA
atcgaagggccaggcaccc

SEQ ID NO: 2669 - RNA, 19 nt, synthetic construct
  source 1..19: mol_type = other RNA
tcgaagggccaggcacccg

SEQ ID NO: 2670 - RNA, 19 nt, synthetic construct
  source 1..19: mol_type = other RNA
ggggtcaccctgctccctc

SEQ ID NO: 2671 - RNA, 19 nt, synthetic construct
  source 1..19: mol_type = other RNA
gggtcaccctgctccctcg

SEQ ID NO: 2672 - RNA, 19 nt, synthetic construct
  source 1..19: mol_type = other RNA
ggtcaccctgctccctcgt

SEQ ID NO: 2673 - RNA, 19 nt, synthetic construct
  source 1..19: mol_type = other RNA
gtcaccctgctccctcgtg

SEQ ID NO: 2674 - RNA, 19 nt, synthetic construct
  source 1..19: mol_type = other RNA
tcaccctgctccctcgtgg

SEQ ID NO: 2675 - RNA, 19 nt, synthetic construct
  source 1..19: mol_type = other RNA
caccctgctccctcgtggg

SEQ ID NO: 2676 - RNA, 19 nt, synthetic construct
  source 1..19: mol_type = other RNA
ccctgctccctcgtgggtc

SEQ ID NO: 2677 - RNA, 19 nt, synthetic construct
  source 1..19: mol_type = other RNA
cctgctccctcgtgggtcg

SEQ ID NO: 2678 - RNA, 19 nt, synthetic construct
  source 1..19: mol_type = other RNA
ctgctccctcgtgggtcgc

SEQ ID NO: 2679 - RNA, 19 nt, synthetic construct
  source 1..19: mol_type = other RNA
tgctccctcgtgggtcgcc

SEQ ID NO: 2680 - RNA, 19 nt, synthetic construct
  source 1..19: mol_type = other RNA
gctccctcgtgggtcgcct

SEQ ID NO: 2681 - RNA, 19 nt, synthetic construct
  source 1..19: mol_type = other RNA
ctccctcgtgggtcgcctt

SEQ ID NO: 2682 - RNA, 19 nt, synthetic construct
  source 1..19: mol_type = other RNA
tccctcgtgggtcgccttc

SEQ ID NO: 2683 - RNA, 19 nt, synthetic construct
  source 1..19: mol_type = other RNA
ccctcgtgggtcgccttcg

SEQ ID NO: 2684 - RNA, 19 nt, synthetic construct
  source 1..19: mol_type = other RNA
cctcgtgggtcgccttcgc

SEQ ID NO: 2685 - RNA, 19 nt, synthetic construct
  source 1..19: mol_type = other RNA
ctcgtgggtcgccttcgcc

SEQ ID NO: 2686 - RNA, 19 nt, synthetic construct
  source 1..19: mol_type = other RNA
tcgtgggtcgccttcgccc

SEQ ID NO: 2687 - RNA, 19 nt, synthetic construct
  source 1..19: mol_type = other RNA
gggtcgccttcgcccacac

SEQ ID NO: 2688 - RNA, 19 nt, synthetic construct
  source 1..19: mol_type = other RNA
ggtcgccttcgcccacacc

SEQ ID NO: 2689 - RNA, 19 nt, synthetic construct
  source 1..19: mol_type = other RNA
gtcgccttcgcccacaccg

SEQ ID NO: 2690 - RNA, 19 nt, synthetic construct
  source 1..19: mol_type = other RNA
tcgccttcgcccacaccgg

SEQ ID NO: 2691 - RNA, 19 nt, synthetic construct
  source 1..19: mol_type = other RNA
cacaccggcgcgtggggaa

SEQ ID NO: 2692 - RNA, 19 nt, synthetic construct
  source 1..19: mol_type = other RNA
acaccggcgcgtggggaac

SEQ ID NO: 2693 - RNA, 19 nt, synthetic construct
  source 1..19: mol_type = other RNA
cgcgtggggaacggggctt

SEQ ID NO: 2694 - RNA, 19 nt, synthetic construct
  source 1..19: mol_type = other RNA
gcgtggggaacggggcttc

SEQ ID NO: 2695 - RNA, 19 nt, synthetic construct
  source 1..19: mol_type = other RNA
ggcttcccgcaccccacgt

SEQ ID NO: 2696 - RNA, 19 nt, synthetic construct
  source 1..19: mol_type = other RNA
gcttcccgcaccccacgtg

SEQ ID NO: 2697 - RNA, 19 nt, synthetic construct
  source 1..19: mol_type = other RNA
ttcgtgagccaggcagcga

SEQ ID NO: 2698 - RNA, 19 nt, synthetic construct
  source 1..19: mol_type = other RNA
tcgtgagccaggcagcgag

SEQ ID NO: 2699 - RNA, 19 nt, synthetic construct
  source 1..19: mol_type = other RNA
cgtgagccaggcagcgagg

SEQ ID NO: 2700 - RNA, 19 nt, synthetic construct
  source 1..19: mol_type = other RNA
gtgagccaggcagcgaggg

SEQ ID NO: 2701 - RNA, 19 nt, synthetic construct
  source 1..19: mol_type = other RNA
cgccggcagaggggatctc

SEQ ID NO: 2702 - RNA, 19 nt, synthetic construct
  source 1..19: mol_type = other RNA
gccggcagaggggatctcc

SEQ ID NO: 2703 - RNA, 19 nt, synthetic construct
  source 1..19: mol_type = other RNA
ccggcagaggggatctccc

SEQ ID NO: 2704 - RNA, 19 nt, synthetic construct
  source 1..19: mol_type = other RNA
cggcagaggggatctccca

SEQ ID NO: 2705 - RNA, 19 nt, synthetic construct
  source 1..19: mol_type = other RNA
ggcagaggggatctcccaa

SEQ ID NO: 2706 - RNA, 19 nt, synthetic construct
  source 1..19: mol_type = other RNA
ggatctcccaacctgcccc

SEQ ID NO: 2707 - RNA, 19 nt, synthetic construct
  source 1..19: mol_type = other RNA
gatctcccaacctgccccg

SEQ ID NO: 2708 - RNA, 19 nt, synthetic construct
  source 1..19: mol_type = other RNA
atctcccaacctgccccgg

SEQ ID NO: 2709 - RNA, 19 nt, synthetic construct
  source 1..19: mol_type = other RNA
tctcccaacctgccccggc

SEQ ID NO: 2710 - RNA, 19 nt, synthetic construct
  source 1..19: mol_type = other RNA
cgcggggatttcgcctacg

SEQ ID NO: 2711 - RNA, 19 nt, synthetic construct
  source 1..19: mol_type = other RNA
gcggggatttcgcctacgc

SEQ ID NO: 2712 - RNA, 19 nt, synthetic construct
  source 1..19: mol_type = other RNA
cggggatttcgcctacgcc

SEQ ID NO: 2713 - RNA, 19 nt, synthetic construct
  source 1..19: mol_type = other RNA
ggggatttcgcctacgccg

SEQ ID NO: 2714 - RNA, 19 nt, synthetic construct
  source 1..19: mol_type = other RNA
gggatttcgcctacgccgc

SEQ ID NO: 2715 - RNA, 19 nt, synthetic construct
  source 1..19: mol_type = other RNA
ggatttcgcctacgccgcc

SEQ ID NO: 2716 - RNA, 19 nt, synthetic construct
  source 1..19: mol_type = other RNA
gatttcgcctacgccgccc

SEQ ID NO: 2717 - RNA, 19 nt, synthetic construct
  source 1..19: mol_type = other RNA
atttcgcctacgccgcccc

SEQ ID NO: 2718 - RNA, 19 nt, synthetic construct
  source 1..19: mol_type = other RNA
tttcgcctacgccgccccg

SEQ ID NO: 2719 - RNA, 19 nt, synthetic construct
  source 1..19: mol_type = other RNA
gggcgctctcccaccctca

SEQ ID NO: 2720 - RNA, 19 nt, synthetic construct
  source 1..19: mol_type = other RNA
ggcgctctcccaccctcag

SEQ ID NO: 2721 - RNA, 19 nt, synthetic construct
  source 1..19: mol_type = other RNA
gcgctctcccaccctcagg

SEQ ID NO: 2722 - RNA, 19 nt, synthetic construct
  source 1..19: mol_type = other RNA
cgctctcccaccctcaggc

SEQ ID NO: 2723 - RNA, 19 nt, synthetic construct
  source 1..19: mol_type = other RNA
gctctcccaccctcaggct

SEQ ID NO: 2724 - RNA, 19 nt, synthetic construct
  source 1..19: mol_type = other RNA
ctctcccaccctcaggctc

SEQ ID NO: 2725 - RNA, 19 nt, synthetic construct
  source 1..19: mol_type = other RNA
tctcccaccctcaggctcc

SEQ ID NO: 2726 - RNA, 19 nt, synthetic construct
  source 1..19: mol_type = other RNA
ctcccaccctcaggctcct

SEQ ID NO: 2727 - RNA, 19 nt, synthetic construct
  source 1..19: mol_type = other RNA
tcccaccctcaggctcctc

SEQ ID NO: 2728 - RNA, 19 nt, synthetic construct
  source 1..19: mol_type = other RNA
cccaccctcaggctcctcg

SEQ ID NO: 2729 - RNA, 19 nt, synthetic construct
  source 1..19: mol_type = other RNA
ccaccctcaggctcctcgg

SEQ ID NO: 2730 - RNA, 19 nt, synthetic construct
  source 1..19: mol_type = other RNA
caccctcaggctcctcggt

SEQ ID NO: 2731 - RNA, 19 nt, synthetic construct
  source 1..19: mol_type = other RNA
accctcaggctcctcggtg

SEQ ID NO: 2732 - RNA, 19 nt, synthetic construct
  source 1..19: mol_type = other RNA
ccctcaggctcctcggtgg

SEQ ID NO: 2733 - RNA, 19 nt, synthetic construct
  source 1..19: mol_type = other RNA
cctcaggctcctcggtggc

SEQ ID NO: 2734 - RNA, 19 nt, synthetic construct
  source 1..19: mol_type = other RNA
ctcaggctcctcggtggcc

SEQ ID NO: 2735 - RNA, 19 nt, synthetic construct
  source 1..19: mol_type = other RNA
ctcctcggtggcctccgca

SEQ ID NO: 2736 - RNA, 19 nt, synthetic construct
  source 1..19: mol_type = other RNA
tcctcggtggcctccgcac

SEQ ID NO: 2737 - RNA, 19 nt, synthetic construct
  source 1..19: mol_type = other RNA
gcctccgcacccgggcaaa

SEQ ID NO: 2738 - RNA, 19 nt, synthetic construct
  source 1..19: mol_type = other RNA
cctccgcacccgggcaaaa

SEQ ID NO: 2739 - RNA, 19 nt, synthetic construct
  source 1..19: mol_type = other RNA
ctccgcacccgggcaaaag

SEQ ID NO: 2740 - RNA, 19 nt, synthetic construct
  source 1..19: mol_type = other RNA
tccgcacccgggcaaaagc

SEQ ID NO: 2741 - RNA, 19 nt, synthetic construct
  source 1..19: mol_type = other RNA
ctgcgcggtggcacagcct

SEQ ID NO: 2742 - RNA, 19 nt, synthetic construct
  source 1..19: mol_type = other RNA
tgcgcggtggcacagcctg

SEQ ID NO: 2743 - RNA, 19 nt, synthetic construct
  source 1..19: mol_type = other RNA
cacagcctgggcccgctca

SEQ ID NO: 2744 - RNA, 19 nt, synthetic construct
  source 1..19: mol_type = other RNA
acagcctgggcccgctcaa

SEQ ID NO: 2745 - RNA, 19 nt, synthetic construct
  source 1..19: mol_type = other RNA
cagcctgggcccgctcaag

SEQ ID NO: 2746 - RNA, 19 nt, synthetic construct
  source 1..19: mol_type = other RNA
agcctgggcccgctcaagc

SEQ ID NO: 2747 - RNA, 19 nt, synthetic construct
  source 1..19: mol_type = other RNA
cgcagggccaaggggtgct

SEQ ID NO: 2748 - RNA, 19 nt, synthetic construct
  source 1..19: mol_type = other RNA
gcagggccaaggggtgctt

SEQ ID NO: 2749 - RNA, 19 nt, synthetic construct
  source 1..19: mol_type = other RNA
ccacccacgtcccagggga

SEQ ID NO: 2750 - RNA, 19 nt, synthetic construct
  source 1..19: mol_type = other RNA
cacccacgtcccaggggag

SEQ ID NO: 2751 - RNA, 19 nt, synthetic construct
  source 1..19: mol_type = other RNA
acccacgtcccaggggagt

SEQ ID NO: 2752 - RNA, 19 nt, synthetic construct
  source 1..19: mol_type = other RNA
cccaggggagtccgtggtg

SEQ ID NO: 2753 - RNA, 19 nt, synthetic construct
  source 1..19: mol_type = other RNA
ccaggggagtccgtggtgg

SEQ ID NO: 2754 - RNA, 19 nt, synthetic construct
  source 1..19: mol_type = other RNA
caggggagtccgtggtggg

SEQ ID NO: 2755 - RNA, 19 nt, synthetic construct
  source 1..19: mol_type = other RNA
aggggagtccgtggtgggg

SEQ ID NO: 2756 - RNA, 19 nt, synthetic construct
  source 1..19: mol_type = other RNA
ggcggcgtgggaaccccaa

SEQ ID NO: 2757 - RNA, 19 nt, synthetic construct
  source 1..19: mol_type = other RNA
ccaagccggggcagctcca

SEQ ID NO: 2758 - RNA, 19 nt, synthetic construct
  source 1..19: mol_type = other RNA
caagccggggcagctccac

SEQ ID NO: 2759 - RNA, 19 nt, synthetic construct
  source 1..19: mol_type = other RNA
aagccggggcagctccacc

SEQ ID NO: 2760 - RNA, 19 nt, synthetic construct
  source 1..19: mol_type = other RNA
gggcagctccacctcccca

SEQ ID NO: 2761 - RNA, 19 nt, synthetic construct
  source 1..19: mol_type = other RNA
ggcagctccacctccccag

SEQ ID NO: 2762 - RNA, 19 nt, synthetic construct
  source 1..19: mol_type = other RNA
gcagctccacctccccagc

SEQ ID NO: 2763 - RNA, 19 nt, synthetic construct
  source 1..19: mol_type = other RNA
cagctccacctccccagcc

SEQ ID NO: 2764 - RNA, 19 nt, synthetic construct
  source 1..19: mol_type = other RNA
cgcggcaggggcagatgca

SEQ ID NO: 2765 - RNA, 19 nt, synthetic construct
  source 1..19: mol_type = other RNA
cggcaggggcagatgcaag

SEQ ID NO: 2766 - RNA, 19 nt, synthetic construct
  source 1..19: mol_type = other RNA
ggcaggggcagatgcaagg

SEQ ID NO: 2767 - RNA, 19 nt, synthetic construct
  source 1..19: mol_type = other RNA
gcaggggcagatgcaaggc

SEQ ID NO: 2768 - RNA, 19 nt, synthetic construct
  source 1..19: mol_type = other RNA
caggggcagatgcaaggca

SEQ ID NO: 2769 - RNA, 19 nt, synthetic construct
  source 1..19: mol_type = other RNA
aggggcagatgcaaggcat

SEQ ID NO: 2770 - RNA, 19 nt, synthetic construct
  source 1..19: mol_type = other RNA
tgcaaggcatcccggcgcc

SEQ ID NO: 2771 - RNA, 19 nt, synthetic construct
  source 1..19: mol_type = other RNA
caaggcatcccggcgccct

SEQ ID NO: 2772 - RNA, 19 nt, synthetic construct
  source 1..19: mol_type = other RNA
aaggcatcccggcgccctc

SEQ ID NO: 2773 - RNA, 19 nt, synthetic construct
  source 1..19: mol_type = other RNA
cctcccaggcgctccagga

SEQ ID NO: 2774 - RNA, 19 nt, synthetic construct
  source 1..19: mol_type = other RNA
ggcgccctggtctgcactc

SEQ ID NO: 2775 - RNA, 19 nt, synthetic construct
  source 1..19: mol_type = other RNA
gcgccctggtctgcactcc

SEQ ID NO: 2776 - RNA, 19 nt, synthetic construct
  source 1..19: mol_type = other RNA
cgccctggtctgcactccc

SEQ ID NO: 2777 - RNA, 19 nt, synthetic construct
  source 1..19: mol_type = other RNA
gccctggtctgcactcccc

SEQ ID NO: 2778 - RNA, 19 nt, synthetic construct
  source 1..19: mol_type = other RNA
ccctggtctgcactcccct

SEQ ID NO: 2779 - RNA, 19 nt, synthetic construct
  source 1..19: mol_type = other RNA
cctggtctgcactcccctg

SEQ ID NO: 2780 - RNA, 19 nt, synthetic construct
  source 1..19: mol_type = other RNA
ctggtctgcactcccctgc

SEQ ID NO: 2781 - RNA, 19 nt, synthetic construct
  source 1..19: mol_type = other RNA
tggtctgcactcccctgcg

SEQ ID NO: 2782 - RNA, 19 nt, synthetic construct
  source 1..19: mol_type = other RNA
ggtctgcactcccctgcgg

SEQ ID NO: 2783 - RNA, 19 nt, synthetic construct
  source 1..19: mol_type = other RNA
gtctgcactcccctgcggc

SEQ ID NO: 2784 - RNA, 19 nt, synthetic construct
  source 1..19: mol_type = other RNA
tctgcactcccctgcggcc

SEQ ID NO: 2785 - RNA, 19 nt, synthetic construct
  source 1..19: mol_type = other RNA
ctgcactcccctgcggcct

SEQ ID NO: 2786 - RNA, 19 nt, synthetic construct
  source 1..19: mol_type = other RNA
tgcactcccctgcggcctg

SEQ ID NO: 2787 - RNA, 19 nt, synthetic construct
  source 1..19: mol_type = other RNA
cactcccctgcggcctgct

SEQ ID NO: 2788 - RNA, 19 nt, synthetic construct
  source 1..19: mol_type = other RNA
actcccctgcggcctgctg

SEQ ID NO: 2789 - RNA, 19 nt, synthetic construct
  source 1..19: mol_type = other RNA
tcccctgcggcctgctgct

SEQ ID NO: 2790 - RNA, 19 nt, synthetic construct
  source 1..19: mol_type = other RNA
cctgcggcctgctgctgga

SEQ ID NO: 2791 - RNA, 19 nt, synthetic construct
  source 1..19: mol_type = other RNA
ctgcggcctgctgctggat

SEQ ID NO: 2792 - RNA, 19 nt, synthetic construct
  source 1..19: mol_type = other RNA
tgcggcctgctgctggatg

SEQ ID NO: 2793 - RNA, 19 nt, synthetic construct
  source 1..19: mol_type = other RNA
gcggcctgctgctggatga

SEQ ID NO: 2794 - RNA, 19 nt, synthetic construct
  source 1..19: mol_type = other RNA
cggcctgctgctggatgag

SEQ ID NO: 2795 - RNA, 19 nt, synthetic construct
  source 1..19: mol_type = other RNA
ggcctgctgctggatgagc

SEQ ID NO: 2796 - RNA, 19 nt, synthetic construct
  source 1..19: mol_type = other RNA
gcctgctgctggatgagct

SEQ ID NO: 2797 - RNA, 19 nt, synthetic construct
  source 1..19: mol_type = other RNA
cctgctgctggatgagctc

SEQ ID NO: 2798 - RNA, 19 nt, synthetic construct
  source 1..19: mol_type = other RNA
ctgctgctggatgagctcc

SEQ ID NO: 2799 - RNA, 19 nt, synthetic construct
  source 1..19: mol_type = other RNA
tgctgctggatgagctcct

SEQ ID NO: 2800 - RNA, 19 nt, synthetic construct
  source 1..19: mol_type = other RNA
gctgctggatgagctcctg

SEQ ID NO: 2801 - RNA, 19 nt, synthetic construct
  source 1..19: mol_type = other RNA
ctgctggatgagctcctgg

SEQ ID NO: 2802 - RNA, 19 nt, synthetic construct
  source 1..19: mol_type = other RNA
tgctggatgagctcctggc

SEQ ID NO: 2803 - RNA, 19 nt, synthetic construct
  source 1..19: mol_type = other RNA
gctggatgagctcctggcg

SEQ ID NO: 2804 - RNA, 19 nt, synthetic construct
  source 1..19: mol_type = other RNA
tcctggcgagcccggagtt

SEQ ID NO: 2805 - RNA, 19 nt, synthetic construct
  source 1..19: mol_type = other RNA
cctggcgagcccggagttt

SEQ ID NO: 2806 - RNA, 19 nt, synthetic construct
  source 1..19: mol_type = other RNA
ctggcgagcccggagtttc

SEQ ID NO: 2807 - RNA, 19 nt, synthetic construct
  source 1..19: mol_type = other RNA
gagcccggagtttctgcag

SEQ ID NO: 2808 - RNA, 19 nt, synthetic construct
  source 1..19: mol_type = other RNA
agcccggagtttctgcagc

SEQ ID NO: 2809 - RNA, 19 nt, synthetic construct
  source 1..19: mol_type = other RNA
gcccggagtttctgcagca

SEQ ID NO: 2810 - RNA, 19 nt, synthetic construct
  source 1..19: mol_type = other RNA
cccggagtttctgcagcag

SEQ ID NO: 2811 - RNA, 19 nt, synthetic construct
  source 1..19: mol_type = other RNA
ccggagtttctgcagcagg

SEQ ID NO: 2812 - RNA, 19 nt, synthetic construct
  source 1..19: mol_type = other RNA
cggagtttctgcagcaggc

SEQ ID NO: 2813 - RNA, 19 nt, synthetic construct
  source 1..19: mol_type = other RNA
ggagtttctgcagcaggcg

SEQ ID NO: 2814 - RNA, 19 nt, synthetic construct
  source 1..19: mol_type = other RNA
gagtttctgcagcaggcgc

SEQ ID NO: 2815 - RNA, 19 nt, synthetic construct
  source 1..19: mol_type = other RNA
agtttctgcagcaggcgca

SEQ ID NO: 2816 - RNA, 19 nt, synthetic construct
  source 1..19: mol_type = other RNA
gtttctgcagcaggcgcaa

SEQ ID NO: 2817 - RNA, 19 nt, synthetic construct
  source 1..19: mol_type = other RNA
tttctgcagcaggcgcaac

SEQ ID NO: 2818 - RNA, 19 nt, synthetic construct
  source 1..19: mol_type = other RNA
ttctgcagcaggcgcaacc

SEQ ID NO: 2819 - RNA, 19 nt, synthetic construct
  source 1..19: mol_type = other RNA
tctgcagcaggcgcaacct

SEQ ID NO: 2820 - RNA, 19 nt, synthetic construct
  source 1..19: mol_type = other RNA
ctgcagcaggcgcaacctc

SEQ ID NO: 2821 - RNA, 19 nt, synthetic construct
  source 1..19: mol_type = other RNA
tgcagcaggcgcaacctct

SEQ ID NO: 2822 - RNA, 19 nt, synthetic construct
  source 1..19: mol_type = other RNA
gcagcaggcgcaacctctc

SEQ ID NO: 2823 - RNA, 19 nt, synthetic construct
  source 1..19: mol_type = other RNA
cagcaggcgcaacctctcc

SEQ ID NO: 2824 - RNA, 19 nt, synthetic construct
  source 1..19: mol_type = other RNA
agcaggcgcaacctctcct

SEQ ID NO: 2825 - RNA, 19 nt, synthetic construct
  source 1..19: mol_type = other RNA
gcaggcgcaacctctccta

SEQ ID NO: 2826 - RNA, 19 nt, synthetic construct
  source 1..19: mol_type = other RNA
caggcgcaacctctcctag

SEQ ID NO: 2827 - RNA, 19 nt, synthetic construct
  source 1..19: mol_type = other RNA
aggcgcaacctctcctaga

SEQ ID NO: 2828 - RNA, 19 nt, synthetic construct
  source 1..19: mol_type = other RNA
ggcgcaacctctcctagaa

SEQ ID NO: 2829 - RNA, 19 nt, synthetic construct
  source 1..19: mol_type = other RNA
gcgcaacctctcctagaaa

SEQ ID NO: 2830 - RNA, 19 nt, synthetic construct
  source 1..19: mol_type = other RNA
cgcaacctctcctagaaac

SEQ ID NO: 2831 - RNA, 19 nt, synthetic construct
  source 1..19: mol_type = other RNA
gcaacctctcctagaaacg

SEQ ID NO: 2832 - RNA, 19 nt, synthetic construct
  source 1..19: mol_type = other RNA
caacctctcctagaaacgg

SEQ ID NO: 2833 - RNA, 19 nt, synthetic construct
  source 1..19: mol_type = other RNA
aacctctcctagaaacgga

SEQ ID NO: 2834 - RNA, 19 nt, synthetic construct
  source 1..19: mol_type = other RNA
tcctagaaacggaggcccc

SEQ ID NO: 2835 - RNA, 19 nt, synthetic construct
  source 1..19: mol_type = other RNA
cctagaaacggaggccccg

SEQ ID NO: 2836 - RNA, 19 nt, synthetic construct
  source 1..19: mol_type = other RNA
ctagaaacggaggccccgg

SEQ ID NO: 2837 - RNA, 19 nt, synthetic construct
  source 1..19: mol_type = other RNA
ccggtgagagactccactc

SEQ ID NO: 2838 - RNA, 19 nt, synthetic construct
  source 1..19: mol_type = other RNA
cggtgagagactccactcc

SEQ ID NO: 2839 - RNA, 19 nt, synthetic construct
  source 1..19: mol_type = other RNA
ggtgagagactccactccg

SEQ ID NO: 2840 - RNA, 19 nt, synthetic construct
  source 1..19: mol_type = other RNA
cccttgttcttccgtgaaa

SEQ ID NO: 2841 - RNA, 19 nt, synthetic construct
  source 1..19: mol_type = other RNA
ccttgttcttccgtgaaat

SEQ ID NO: 2842 - RNA, 19 nt, synthetic construct
  source 1..19: mol_type = other RNA
cttgttcttccgtgaaatt

SEQ ID NO: 2843 - RNA, 19 nt, synthetic construct
  source 1..19: mol_type = other RNA
ttgttcttccgtgaaattc

SEQ ID NO: 2844 - RNA, 19 nt, synthetic construct
  source 1..19: mol_type = other RNA
tgttcttccgtgaaattct

SEQ ID NO: 2845 - RNA, 19 nt, synthetic construct
  source 1..19: mol_type = other RNA
gttcttccgtgaaattctg

SEQ ID NO: 2846 - RNA, 19 nt, synthetic construct
  source 1..19: mol_type = other RNA
ttcttccgtgaaattctgg

SEQ ID NO: 2847 - RNA, 19 nt, synthetic construct
  source 1..19: mol_type = other RNA
tcttccgtgaaattctggc

SEQ ID NO: 2848 - RNA, 19 nt, synthetic construct
  source 1..19: mol_type = other RNA
cttccgtgaaattctggct

SEQ ID NO: 2849 - RNA, 19 nt, synthetic construct
  source 1..19: mol_type = other RNA
ttctggctgaatgtctccc

SEQ ID NO: 2850 - RNA, 19 nt, synthetic construct
  source 1..19: mol_type = other RNA
tctggctgaatgtctcccc

SEQ ID NO: 2851 - RNA, 19 nt, synthetic construct
  source 1..19: mol_type = other RNA
gacgctgtctaggcaaacc

SEQ ID NO: 2852 - RNA, 19 nt, synthetic construct
  source 1..19: mol_type = other RNA
acgctgtctaggcaaacct

SEQ ID NO: 2853 - RNA, 19 nt, synthetic construct
  source 1..19: mol_type = other RNA
cgctgtctaggcaaacctg

SEQ ID NO: 2854 - RNA, 19 nt, synthetic construct
  source 1..19: mol_type = other RNA
gctgtctaggcaaacctgg

SEQ ID NO: 2855 - RNA, 19 nt, synthetic construct
  source 1..19: mol_type = other RNA
ctgtctaggcaaacctgga

SEQ ID NO: 2856 - RNA, 19 nt, synthetic construct
  source 1..19: mol_type = other RNA
tgtctaggcaaacctggat

SEQ ID NO: 2857 - RNA, 19 nt, synthetic construct
  source 1..19: mol_type = other RNA
gtctaggcaaacctggatt

SEQ ID NO: 2858 - RNA, 19 nt, synthetic construct
  source 1..19: mol_type = other RNA
tctaggcaaacctggatta

SEQ ID NO: 2859 - RNA, 19 nt, synthetic construct
  source 1..19: mol_type = other RNA
ctaggcaaacctggattag

SEQ ID NO: 2860 - RNA, 19 nt, synthetic construct
  source 1..19: mol_type = other RNA
taggcaaacctggattaga

SEQ ID NO: 2861 - RNA, 19 nt, synthetic construct
  source 1..19: mol_type = other RNA
aggcaaacctggattagag

SEQ ID NO: 2862 - RNA, 19 nt, synthetic construct
  source 1..19: mol_type = other RNA
ggcaaacctggattagagt

SEQ ID NO: 2863 - RNA, 19 nt, synthetic construct
  source 1..19: mol_type = other RNA
gcaaacctggattagagtt

SEQ ID NO: 2864 - RNA, 19 nt, synthetic construct
  source 1..19: mol_type = other RNA
caaacctggattagagtta

SEQ ID NO: 2865 - RNA, 19 nt, synthetic construct
  source 1..19: mol_type = other RNA
aaacctggattagagttac

SEQ ID NO: 2866 - RNA, 19 nt, synthetic construct
  source 1..19: mol_type = other RNA
aacctggattagagttaca

SEQ ID NO: 2867 - RNA, 19 nt, synthetic construct
  source 1..19: mol_type = other RNA
acctggattagagttacat

SEQ ID NO: 2868 - RNA, 19 nt, synthetic construct
  source 1..19: mol_type = other RNA
cctggattagagttacatc

SEQ ID NO: 2869 - RNA, 19 nt, synthetic construct
  source 1..19: mol_type = other RNA
ctggattagagttacatct

SEQ ID NO: 2870 - RNA, 19 nt, synthetic construct
  source 1..19: mol_type = other RNA
tggattagagttacatctc

SEQ ID NO: 2871 - RNA, 19 nt, synthetic construct
  source 1..19: mol_type = other RNA
ggattagagttacatctcc

SEQ ID NO: 2872 - RNA, 19 nt, synthetic construct
  source 1..19: mol_type = other RNA
gattagagttacatctcct

SEQ ID NO: 2873 - RNA, 19 nt, synthetic construct
  source 1..19: mol_type = other RNA
attagagttacatctcctg

SEQ ID NO: 2874 - RNA, 19 nt, synthetic construct
  source 1..19: mol_type = other RNA
ttagagttacatctcctgg

SEQ ID NO: 2875 - RNA, 19 nt, synthetic construct
  source 1..19: mol_type = other RNA
tagagttacatctcctgga

SEQ ID NO: 2876 - RNA, 19 nt, synthetic construct
  source 1..19: mol_type = other RNA
agagttacatctcctggat

SEQ ID NO: 2877 - RNA, 19 nt, synthetic construct
  source 1..19: mol_type = other RNA
atctcctggatgattagtt

SEQ ID NO: 2878 - RNA, 19 nt, synthetic construct
  source 1..19: mol_type = other RNA
tctcctggatgattagttc

SEQ ID NO: 2879 - RNA, 19 nt, synthetic construct
  source 1..19: mol_type = other RNA
ctcctggatgattagttca

SEQ ID NO: 2880 - RNA, 19 nt, synthetic construct
  source 1..19: mol_type = other RNA
tcctggatgattagttcag

SEQ ID NO: 2881 - RNA, 19 nt, synthetic construct
  source 1..19: mol_type = other RNA
cctggatgattagttcaga

SEQ ID NO: 2882 - RNA, 19 nt, synthetic construct
  source 1..19: mol_type = other RNA
ctggatgattagttcagag

SEQ ID NO: 2883 - RNA, 19 nt, synthetic construct
  source 1..19: mol_type = other RNA
gcaccctccccgcggaagc

SEQ ID NO: 2884 - RNA, 19 nt, synthetic construct
  source 1..19: mol_type = other RNA
caccctccccgcggaagcc

SEQ ID NO: 2885 - RNA, 19 nt, synthetic construct
  source 1..19: mol_type = other RNA
accctccccgcggaagccc

SEQ ID NO: 2886 - RNA, 19 nt, synthetic construct
  source 1..19: mol_type = other RNA
cctccccgcggaagcccgg

SEQ ID NO: 2887 - RNA, 19 nt, synthetic construct
  source 1..19: mol_type = other RNA
atttggtttcagaatgaga

SEQ ID NO: 2888 - RNA, 19 nt, synthetic construct
  source 1..19: mol_type = other RNA
accggcgggaatctcggcc

SEQ ID NO: 2889 - RNA, 19 nt, synthetic construct
  source 1..19: mol_type = other RNA
ccctggcccgggagacgcg

SEQ ID NO: 2890 - RNA, 19 nt, synthetic construct
  source 1..19: mol_type = other RNA
cctggcccgggagacgcgg

SEQ ID NO: 2891 - RNA, 19 nt, synthetic construct
  source 1..19: mol_type = other RNA
ctggcccgggagacgcggc

SEQ ID NO: 2892 - RNA, 19 nt, synthetic construct
  source 1..19: mol_type = other RNA
ccgccctgctcctccgagc

SEQ ID NO: 2893 - RNA, 19 nt, synthetic construct
  source 1..19: mol_type = other RNA
ccaggcatcgccgcccggg

SEQ ID NO: 2894 - RNA, 19 nt, synthetic construct
  source 1..19: mol_type = other RNA
gcatcgccgcccgggagga

SEQ ID NO: 2895 - RNA, 19 nt, synthetic construct
  source 1..19: mol_type = other RNA
catcgccgcccgggaggag

SEQ ID NO: 2896 - RNA, 19 nt, synthetic construct
  source 1..19: mol_type = other RNA
atcgccgcccgggaggagc

SEQ ID NO: 2897 - RNA, 19 nt, synthetic construct
  source 1..19: mol_type = other RNA
tcgccgcccgggaggagct

SEQ ID NO: 2898 - RNA, 19 nt, synthetic construct
  source 1..19: mol_type = other RNA
cgccgcccgggaggagctg

SEQ ID NO: 2899 - RNA, 19 nt, synthetic construct
  source 1..19: mol_type = other RNA
gacagggtggcagggcgcc

SEQ ID NO: 2900 - RNA, 19 nt, synthetic construct
  source 1..19: mol_type = other RNA
acagggtggcagggcgccc

SEQ ID NO: 2901 - RNA, 19 nt, synthetic construct
  source 1..19: mol_type = other RNA
agggtggcagggcgcccgc

SEQ ID NO: 2902 - RNA, 19 nt, synthetic construct
  source 1..19: mol_type = other RNA
gggtggcagggcgcccgcg

SEQ ID NO: 2903 - RNA, 19 nt, synthetic construct
  source 1..19: mol_type = other RNA
gtggcagggcgcccgcgca

SEQ ID NO: 2904 - RNA, 19 nt, synthetic construct
  source 1..19: mol_type = other RNA
aggcggcctgtgcagcgcg

SEQ ID NO: 2905 - RNA, 19 nt, synthetic construct
  source 1..19: mol_type = other RNA
ggcggcctgtgcagcgcgg

SEQ ID NO: 2906 - RNA, 19 nt, synthetic construct
  source 1..19: mol_type = other RNA
gcggcctgtgcagcgcggc

SEQ ID NO: 2907 - RNA, 19 nt, synthetic construct
  source 1..19: mol_type = other RNA
cgccttcgcccacaccggc

SEQ ID NO: 2908 - RNA, 19 nt, synthetic construct
  source 1..19: mol_type = other RNA
caccggcgcgtggggaacg

SEQ ID NO: 2909 - RNA, 19 nt, synthetic construct
  source 1..19: mol_type = other RNA
accggcgcgtggggaacgg

SEQ ID NO: 2910 - RNA, 19 nt, synthetic construct
  source 1..19: mol_type = other RNA
ccggcgcgtggggaacggg

SEQ ID NO: 2911 - RNA, 19 nt, synthetic construct
  source 1..19: mol_type = other RNA
cggcgcgtggggaacgggg

SEQ ID NO: 2912 - RNA, 19 nt, synthetic construct
  source 1..19: mol_type = other RNA
gcgcgtggggaacggggct

SEQ ID NO: 2913 - RNA, 19 nt, synthetic construct
  source 1..19: mol_type = other RNA
gggcttcccgcaccccacg

SEQ ID NO: 2914 - RNA, 19 nt, synthetic construct
  source 1..19: mol_type = other RNA
caccccacgtgccctgcgc

SEQ ID NO: 2915 - RNA, 19 nt, synthetic construct
  source 1..19: mol_type = other RNA
ccccacgtgccctgcgcgc

SEQ ID NO: 2916 - RNA, 19 nt, synthetic construct
  source 1..19: mol_type = other RNA
ccacgtgccctgcgcgcct

SEQ ID NO: 2917 - RNA, 19 nt, synthetic construct
  source 1..19: mol_type = other RNA
acgtgccctgcgcgcctgg

SEQ ID NO: 2918 - RNA, 19 nt, synthetic construct
  source 1..19: mol_type = other RNA
ctgcgcgcctggggctctc

SEQ ID NO: 2919 - RNA, 19 nt, synthetic construct
  source 1..19: mol_type = other RNA
gctttcgtgagccaggcag

SEQ ID NO: 2920 - RNA, 19 nt, synthetic construct
  source 1..19: mol_type = other RNA
ctttcgtgagccaggcagc

SEQ ID NO: 2921 - RNA, 19 nt, synthetic construct
  source 1..19: mol_type = other RNA
tttcgtgagccaggcagcg

SEQ ID NO: 2922 - RNA, 19 nt, synthetic construct
  source 1..19: mol_type = other RNA
ctgcagcccagccaggccg

SEQ ID NO: 2923 - RNA, 19 nt, synthetic construct
  source 1..19: mol_type = other RNA
ccgcgccggcagaggggat

SEQ ID NO: 2924 - RNA, 19 nt, synthetic construct
  source 1..19: mol_type = other RNA
ccaacctgccccggcgcgc

SEQ ID NO: 2925 - RNA, 19 nt, synthetic construct
  source 1..19: mol_type = other RNA
aacctgccccggcgcgcgg

SEQ ID NO: 2926 - RNA, 19 nt, synthetic construct
  source 1..19: mol_type = other RNA
gcgcggggatttcgcctac

SEQ ID NO: 2927 - RNA, 19 nt, synthetic construct
  source 1..19: mol_type = other RNA
ttcgcctacgccgccccgg

SEQ ID NO: 2928 - RNA, 19 nt, synthetic construct
  source 1..19: mol_type = other RNA
cgcctacgccgccccggct

SEQ ID NO: 2929 - RNA, 19 nt, synthetic construct
  source 1..19: mol_type = other RNA
ggctcctccggacggggcg

SEQ ID NO: 2930 - RNA, 19 nt, synthetic construct
  source 1..19: mol_type = other RNA
gctcctccggacggggcgc

SEQ ID NO: 2931 - RNA, 19 nt, synthetic construct
  source 1..19: mol_type = other RNA
ggggcgctctcccaccctc

SEQ ID NO: 2932 - RNA, 19 nt, synthetic construct
  source 1..19: mol_type = other RNA
cccgcagcgcgacggcctg

SEQ ID NO: 2933 - RNA, 19 nt, synthetic construct
  source 1..19: mol_type = other RNA
gcctgccgggcccctgcgc

SEQ ID NO: 2934 - RNA, 19 nt, synthetic construct
  source 1..19: mol_type = other RNA
cctgcgcggtggcacagcc

SEQ ID NO: 2935 - RNA, 19 nt, synthetic construct
  source 1..19: mol_type = other RNA
gcgcggtggcacagcctgg

SEQ ID NO: 2936 - RNA, 19 nt, synthetic construct
  source 1..19: mol_type = other RNA
cgcggtggcacagcctggg

SEQ ID NO: 2937 - RNA, 19 nt, synthetic construct
  source 1..19: mol_type = other RNA
cggtggcacagcctgggcc

SEQ ID NO: 2938 - RNA, 19 nt, synthetic construct
  source 1..19: mol_type = other RNA
gcacagcctgggcccgctc

SEQ ID NO: 2939 - RNA, 19 nt, synthetic construct
  source 1..19: mol_type = other RNA
cctgggcccgctcaagcgg

SEQ ID NO: 2940 - RNA, 19 nt, synthetic construct
  source 1..19: mol_type = other RNA
ccgcagggccaaggggtgc

SEQ ID NO: 2941 - RNA, 19 nt, synthetic construct
  source 1..19: mol_type = other RNA
gtgcttgcgccacccacgt

SEQ ID NO: 2942 - RNA, 19 nt, synthetic construct
  source 1..19: mol_type = other RNA
tgcttgcgccacccacgtc

SEQ ID NO: 2943 - RNA, 19 nt, synthetic construct
  source 1..19: mol_type = other RNA
gcttgcgccacccacgtcc

SEQ ID NO: 2944 - RNA, 19 nt, synthetic construct
  source 1..19: mol_type = other RNA
cttgcgccacccacgtccc

SEQ ID NO: 2945 - RNA, 19 nt, synthetic construct
  source 1..19: mol_type = other RNA
tgcgccacccacgtcccag

SEQ ID NO: 2946 - RNA, 19 nt, synthetic construct
  source 1..19: mol_type = other RNA
agtccgtggtggggctggg

SEQ ID NO: 2947 - RNA, 19 nt, synthetic construct
  source 1..19: mol_type = other RNA
gggccggggtccccaggtc

SEQ ID NO: 2948 - RNA, 19 nt, synthetic construct
  source 1..19: mol_type = other RNA
ccggggtccccaggtcgcc

SEQ ID NO: 2949 - RNA, 19 nt, synthetic construct
  source 1..19: mol_type = other RNA
ccggggcggcgtgggaacc

SEQ ID NO: 2950 - RNA, 19 nt, synthetic construct
  source 1..19: mol_type = other RNA
ctccacctccccagcccgc

SEQ ID NO: 2951 - RNA, 19 nt, synthetic construct
  source 1..19: mol_type = other RNA
cacctccccagcccgcgcc

SEQ ID NO: 2952 - RNA, 19 nt, synthetic construct
  source 1..19: mol_type = other RNA
cctccccagcccgcgcccc

SEQ ID NO: 2953 - RNA, 19 nt, synthetic construct
  source 1..19: mol_type = other RNA
cgcctccgcgcggcagggg

SEQ ID NO: 2954 - RNA, 19 nt, synthetic construct
  source 1..19: mol_type = other RNA
ccgcgcggcaggggcagat

SEQ ID NO: 2955 - RNA, 19 nt, synthetic construct
  source 1..19: mol_type = other RNA
gcgcggcaggggcagatgc

SEQ ID NO: 2956 - RNA, 19 nt, synthetic construct
  source 1..19: mol_type = other RNA
cccaggcgctccaggagcc

SEQ ID NO: 2957 - RNA, 19 nt, synthetic construct
  source 1..19: mol_type = other RNA
gagccggcgccctggtctg

SEQ ID NO: 2958 - RNA, 19 nt, synthetic construct
  source 1..19: mol_type = other RNA
gccggcgccctggtctgca

SEQ ID NO: 2959 - RNA, 19 nt, synthetic construct
  source 1..19: mol_type = other RNA
ccggcgccctggtctgcac

SEQ ID NO: 2960 - RNA, 19 nt, synthetic construct
  source 1..19: mol_type = other RNA
cggcgccctggtctgcact

SEQ ID NO: 2961 - RNA, 19 nt, synthetic construct
  source 1..19: mol_type = other RNA
ctcccctgcggcctgctgc

SEQ ID NO: 2962 - RNA, 19 nt, synthetic construct
  source 1..19: mol_type = other RNA
ctggatgagctcctggcga

SEQ ID NO: 2963 - RNA, 19 nt, synthetic construct
  source 1..19: mol_type = other RNA
ggggagctggaggcctcgg

SEQ ID NO: 2964 - RNA, 19 nt, synthetic construct
  source 1..19: mol_type = other RNA
gagctggaggcctcggaag

SEQ ID NO: 2965 - RNA, 19 nt, synthetic construct
  source 1..19: mol_type = other RNA
agctggaggcctcggaaga

SEQ ID NO: 2966 - RNA, 19 nt, synthetic construct
  source 1..19: mol_type = other RNA
gctggaggcctcggaagag

SEQ ID NO: 2967 - RNA, 19 nt, synthetic construct
  source 1..19: mol_type = other RNA
ggccgcctcgctggaagca

SEQ ID NO: 2968 - RNA, 19 nt, synthetic construct
  source 1..19: mol_type = other RNA
gccgcctcgctggaagcac

SEQ ID NO: 2969 - RNA, 19 nt, synthetic construct
  source 1..19: mol_type = other RNA
ccgcctcgctggaagcacc

SEQ ID NO: 2970 - RNA, 19 nt, synthetic construct
  source 1..19: mol_type = other RNA
cgcctcgctggaagcaccc

SEQ ID NO: 2971 - RNA, 19 nt, synthetic construct
  source 1..19: mol_type = other RNA
gcctcgctggaagcacccc

SEQ ID NO: 2972 - RNA, 19 nt, synthetic construct
  source 1..19: mol_type = other RNA
ctcgctggaagcacccctc

SEQ ID NO: 2973 - RNA, 19 nt, synthetic construct
  source 1..19: mol_type = other RNA
ctcagcgaggaagaatacc

SEQ ID NO: 2974 - RNA, 19 nt, synthetic construct
  source 1..19: mol_type = other RNA
tcagcgaggaagaataccg

SEQ ID NO: 2975 - RNA, 19 nt, synthetic construct
  source 1..19: mol_type = other RNA
ggaagaataccgggctctg

SEQ ID NO: 2976 - RNA, 19 nt, synthetic construct
  source 1..19: mol_type = other RNA
ccgggctctgctggaggag

SEQ ID NO: 2977 - RNA, 19 nt, synthetic construct
  source 1..19: mol_type = other RNA
tctgctggaggagctttag

SEQ ID NO: 2978 - RNA, 19 nt, synthetic construct
  source 1..19: mol_type = other RNA
ctgctggaggagctttagg

SEQ ID NO: 2979 - RNA, 19 nt, synthetic construct
  source 1..19: mol_type = other RNA
gctggaggagctttaggac

SEQ ID NO: 2980 - RNA, 19 nt, synthetic construct
  source 1..19: mol_type = other RNA
ctggaggagctttaggacg

SEQ ID NO: 2981 - RNA, 19 nt, synthetic construct
  source 1..19: mol_type = other RNA
aggagctttaggacgcggg

SEQ ID NO: 2982 - RNA, 19 nt, synthetic construct
  source 1..19: mol_type = other RNA
ggagctttaggacgcgggg

SEQ ID NO: 2983 - RNA, 19 nt, synthetic construct
  source 1..19: mol_type = other RNA
gagctttaggacgcggggt

SEQ ID NO: 2984 - RNA, 19 nt, synthetic construct
  source 1..19: mol_type = other RNA
agctttaggacgcggggtt

SEQ ID NO: 2985 - RNA, 19 nt, synthetic construct
  source 1..19: mol_type = other RNA
gctttaggacgcggggttg

SEQ ID NO: 2986 - RNA, 19 nt, synthetic construct
  source 1..19: mol_type = other RNA
ctttaggacgcggggttgg

SEQ ID NO: 2987 - RNA, 19 nt, synthetic construct
  source 1..19: mol_type = other RNA
tttaggacgcggggttggg

SEQ ID NO: 2988 - RNA, 19 nt, synthetic construct
  source 1..19: mol_type = other RNA
ttaggacgcggggttggga

SEQ ID NO: 2989 - RNA, 19 nt, synthetic construct
  source 1..19: mol_type = other RNA
aggacgcggggttgggacg

SEQ ID NO: 2990 - RNA, 19 nt, synthetic construct
  source 1..19: mol_type = other RNA
gcggggttgggacggggtc

SEQ ID NO: 2991 - RNA, 19 nt, synthetic construct
  source 1..19: mol_type = other RNA
gttgggacggggtcgggtg

SEQ ID NO: 2992 - RNA, 19 nt, synthetic construct
  source 1..19: mol_type = other RNA
ggacggggtcgggtggttc

SEQ ID NO: 2993 - RNA, 19 nt, synthetic construct
  source 1..19: mol_type = other RNA
ggctgaccggcctgggatt

SEQ ID NO: 2994 - RNA, 19 nt, synthetic construct
  source 1..19: mol_type = other RNA
gctgaccggcctgggattc

SEQ ID NO: 2995 - RNA, 19 nt, synthetic construct
  source 1..19: mol_type = other RNA
ctgggattcctgccttcta

SEQ ID NO: 2996 - RNA, 19 nt, synthetic construct
  source 1..19: mol_type = other RNA
tgggattcctgccttctag

SEQ ID NO: 2997 - RNA, 19 nt, synthetic construct
  source 1..19: mol_type = other RNA
ggtctaggcccggtgagag

SEQ ID NO: 2998 - RNA, 19 nt, synthetic construct
  source 1..19: mol_type = other RNA
gtctaggcccggtgagaga

SEQ ID NO: 2999 - RNA, 19 nt, synthetic construct
  source 1..19: mol_type = other RNA
tctaggcccggtgagagac

SEQ ID NO: 3000 - RNA, 19 nt, synthetic construct
  source 1..19: mol_type = other RNA
ctaggcccggtgagagact

SEQ ID NO: 3001 - RNA, 19 nt, synthetic construct
  source 1..19: mol_type = other RNA
ggcccggtgagagactcca

SEQ ID NO: 3002 - RNA, 19 nt, synthetic construct
  source 1..19: mol_type = other RNA
gcccggtgagagactccac

SEQ ID NO: 3003 - RNA, 19 nt, synthetic construct
  source 1..19: mol_type = other RNA
cccggtgagagactccact

SEQ ID NO: 3004 - RNA, 19 nt, synthetic construct
  source 1..19: mol_type = other RNA
ccccaccttccgacgctgt

SEQ ID NO: 3005 - RNA, 19 nt, synthetic construct
  source 1..19: mol_type = other RNA
cccaccttccgacgctgtc

SEQ ID NO: 3006 - RNA, 19 nt, synthetic construct
  source 1..19: mol_type = other RNA
ccttccgacgctgtctagg

SEQ ID NO: 3007 - RNA, 19 nt, synthetic construct
  source 1..19: mol_type = other RNA
cttccgacgctgtctaggc

SEQ ID NO: 3008 - RNA, 19 nt, synthetic construct
  source 1..19: mol_type = other RNA
ttccgacgctgtctaggca

SEQ ID NO: 3009 - RNA, 19 nt, synthetic construct
  source 1..19: mol_type = other RNA
tccgacgctgtctaggcaa

SEQ ID NO: 3010 - RNA, 19 nt, synthetic construct
  source 1..19: mol_type = other RNA
ccgacgctgtctaggcaaa

SEQ ID NO: 3011 - RNA, 19 nt, synthetic construct
  source 1..19: mol_type = other RNA
cgacgctgtctaggcaaac

SEQ ID NO: 3012 - RNA, 19 nt, synthetic construct
  source 1..19: mol_type = other RNA
agggtgtcgggagggccat

SEQ ID NO: 3013 - RNA, 19 nt, synthetic construct
  source 1..19: mol_type = other RNA
gagggtgtcgggagggcca

SEQ ID NO: 3014 - RNA, 19 nt, synthetic construct
  source 1..19: mol_type = other RNA
gtgctgtccgagggtgtcg

SEQ ID NO: 3015 - RNA, 19 nt, synthetic construct
  source 1..19: mol_type = other RNA
ggtgctgtccgagggtgtc

SEQ ID NO: 3016 - RNA, 19 nt, synthetic construct
  source 1..19: mol_type = other RNA
gggtgctgtccgagggtgt

SEQ ID NO: 3017 - RNA, 19 nt, synthetic construct
  source 1..19: mol_type = other RNA
agggtgctgtccgagggtg

SEQ ID NO: 3018 - RNA, 19 nt, synthetic construct
  source 1..19: mol_type = other RNA
gagggtgctgtccgagggt

SEQ ID NO: 3019 - RNA, 19 nt, synthetic construct
  source 1..19: mol_type = other RNA
ggagggtgctgtccgaggg

SEQ ID NO: 3020 - RNA, 19 nt, synthetic construct
  source 1..19: mol_type = other RNA
gggagggtgctgtccgagg

SEQ ID NO: 3021 - RNA, 19 nt, synthetic construct
  source 1..19: mol_type = other RNA
ggggagggtgctgtccgag

SEQ ID NO: 3022 - RNA, 19 nt, synthetic construct
  source 1..19: mol_type = other RNA
cggggagggtgctgtccga

SEQ ID NO: 3023 - RNA, 19 nt, synthetic construct
  source 1..19: mol_type = other RNA
tccgcggggagggtgctgt

SEQ ID NO: 3024 - RNA, 19 nt, synthetic construct
  source 1..19: mol_type = other RNA
ttccgcggggagggtgctg

SEQ ID NO: 3025 - RNA, 19 nt, synthetic construct
  source 1..19: mol_type = other RNA
cttccgcggggagggtgct

SEQ ID NO: 3026 - RNA, 19 nt, synthetic construct
  source 1..19: mol_type = other RNA
tcctcgtccccgggcttcc

SEQ ID NO: 3027 - RNA, 19 nt, synthetic construct
  source 1..19: mol_type = other RNA
gtcctcgtccccgggcttc

SEQ ID NO: 3028 - RNA, 19 nt, synthetic construct
  source 1..19: mol_type = other RNA
cgtcctcgtccccgggctt

SEQ ID NO: 3029 - RNA, 19 nt, synthetic construct
  source 1..19: mol_type = other RNA
tccgtcgccgtcctcgtcc

SEQ ID NO: 3030 - RNA, 19 nt, synthetic construct
  source 1..19: mol_type = other RNA
ctccgtcgccgtcctcgtc

SEQ ID NO: 3031 - RNA, 19 nt, synthetic construct
  source 1..19: mol_type = other RNA
tctccgtcgccgtcctcgt

SEQ ID NO: 3032 - RNA, 19 nt, synthetic construct
  source 1..19: mol_type = other RNA
gtctccgtcgccgtcctcg

SEQ ID NO: 3033 - RNA, 19 nt, synthetic construct
  source 1..19: mol_type = other RNA
agtctccgtcgccgtcctc

SEQ ID NO: 3034 - RNA, 19 nt, synthetic construct
  source 1..19: mol_type = other RNA
gagtctccgtcgccgtcct

SEQ ID NO: 3035 - RNA, 19 nt, synthetic construct
  source 1..19: mol_type = other RNA
cgagtctccgtcgccgtcc

SEQ ID NO: 3036 - RNA, 19 nt, synthetic construct
  source 1..19: mol_type = other RNA
acgagtctccgtcgccgtc

SEQ ID NO: 3037 - RNA, 19 nt, synthetic construct
  source 1..19: mol_type = other RNA
aacgagtctccgtcgccgt

SEQ ID NO: 3038 - RNA, 19 nt, synthetic construct
  source 1..19: mol_type = other RNA
ccaaacgagtctccgtcgc

SEQ ID NO: 3039 - RNA, 19 nt, synthetic construct
  source 1..19: mol_type = other RNA
tccaaacgagtctccgtcg

SEQ ID NO: 3040 - RNA, 19 nt, synthetic construct
  source 1..19: mol_type = other RNA
gtccaaacgagtctccgtc

SEQ ID NO: 3041 - RNA, 19 nt, synthetic construct
  source 1..19: mol_type = other RNA
ggtccaaacgagtctccgt

SEQ ID NO: 3042 - RNA, 19 nt, synthetic construct
  source 1..19: mol_type = other RNA
gggtccaaacgagtctccg

SEQ ID NO: 3043 - RNA, 19 nt, synthetic construct
  source 1..19: mol_type = other RNA
ggggtccaaacgagtctcc

SEQ ID NO: 3044 - RNA, 19 nt, synthetic construct
  source 1..19: mol_type = other RNA
cggggtccaaacgagtctc

SEQ ID NO: 3045 - RNA, 19 nt, synthetic construct
  source 1..19: mol_type = other RNA
tcggggtccaaacgagtct

SEQ ID NO: 3046 - RNA, 19 nt, synthetic construct
  source 1..19: mol_type = other RNA
tggctcggggtccaaacga

SEQ ID NO: 3047 - RNA, 19 nt, synthetic construct
  source 1..19: mol_type = other RNA
cgctttggctcggggtcca

SEQ ID NO: 3048 - RNA, 19 nt, synthetic construct
  source 1..19: mol_type = other RNA
tcgctttggctcggggtcc

SEQ ID NO: 3049 - RNA, 19 nt, synthetic construct
  source 1..19: mol_type = other RNA
ctcgctttggctcggggtc

SEQ ID NO: 3050 - RNA, 19 nt, synthetic construct
  source 1..19: mol_type = other RNA
cctcgctttggctcggggt

SEQ ID NO: 3051 - RNA, 19 nt, synthetic construct
  source 1..19: mol_type = other RNA
gcctcgctttggctcgggg

SEQ ID NO: 3052 - RNA, 19 nt, synthetic construct
  source 1..19: mol_type = other RNA
ggcctcgctttggctcggg

SEQ ID NO: 3053 - RNA, 19 nt, synthetic construct
  source 1..19: mol_type = other RNA
gggcctcgctttggctcgg

SEQ ID NO: 3054 - RNA, 19 nt, synthetic construct
  source 1..19: mol_type = other RNA
agggcctcgctttggctcg

SEQ ID NO: 3055 - RNA, 19 nt, synthetic construct
  source 1..19: mol_type = other RNA
cagggcctcgctttggctc

SEQ ID NO: 3056 - RNA, 19 nt, synthetic construct
  source 1..19: mol_type = other RNA
gcagggcctcgctttggct

SEQ ID NO: 3057 - RNA, 19 nt, synthetic construct
  source 1..19: mol_type = other RNA
cgcagggcctcgctttggc

SEQ ID NO: 3058 - RNA, 19 nt, synthetic construct
  source 1..19: mol_type = other RNA
tcgcagggcctcgctttgg

SEQ ID NO: 3059 - RNA, 19 nt, synthetic construct
  source 1..19: mol_type = other RNA
ctcgcagggcctcgctttg

SEQ ID NO: 3060 - RNA, 19 nt, synthetic construct
  source 1..19: mol_type = other RNA
gctcgcagggcctcgcttt

SEQ ID NO: 3061 - RNA, 19 nt, synthetic construct
  source 1..19: mol_type = other RNA
ggctcgcagggcctcgctt

SEQ ID NO: 3062 - RNA, 19 nt, synthetic construct
  source 1..19: mol_type = other RNA
cgggttccgctcaaagcag

SEQ ID NO: 3063 - RNA, 19 nt, synthetic construct
  source 1..19: mol_type = other RNA
acgggttccgctcaaagca

SEQ ID NO: 3064 - RNA, 19 nt, synthetic construct
  source 1..19: mol_type = other RNA
tacgggttccgctcaaagc

SEQ ID NO: 3065 - RNA, 19 nt, synthetic construct
  source 1..19: mol_type = other RNA
gtacgggttccgctcaaag

SEQ ID NO: 3066 - RNA, 19 nt, synthetic construct
  source 1..19: mol_type = other RNA
ggtacgggttccgctcaaa

SEQ ID NO: 3067 - RNA, 19 nt, synthetic construct
  source 1..19: mol_type = other RNA
gggtacgggttccgctcaa

SEQ ID NO: 3068 - RNA, 19 nt, synthetic construct
  source 1..19: mol_type = other RNA
cgggtacgggttccgctca

SEQ ID NO: 3069 - RNA, 19 nt, synthetic construct
  source 1..19: mol_type = other RNA
ccgggtacgggttccgctc

SEQ ID NO: 3070 - RNA, 19 nt, synthetic construct
  source 1..19: mol_type = other RNA
cccgggtacgggttccgct

SEQ ID NO: 3071 - RNA, 19 nt, synthetic construct
  source 1..19: mol_type = other RNA
tggcgatgcccgggtacgg

SEQ ID NO: 3072 - RNA, 19 nt, synthetic construct
  source 1..19: mol_type = other RNA
gtggcgatgcccgggtacg

SEQ ID NO: 3073 - RNA, 19 nt, synthetic construct
  source 1..19: mol_type = other RNA
ggtggcgatgcccgggtac

SEQ ID NO: 3074 - RNA, 19 nt, synthetic construct
  source 1..19: mol_type = other RNA
tggtggcgatgcccgggta

SEQ ID NO: 3075 - RNA, 19 nt, synthetic construct
  source 1..19: mol_type = other RNA
tctggtggcgatgcccggg

SEQ ID NO: 3076 - RNA, 19 nt, synthetic construct
  source 1..19: mol_type = other RNA
ctctggtggcgatgcccgg

SEQ ID NO: 3077 - RNA, 19 nt, synthetic construct
  source 1..19: mol_type = other RNA
tctctggtggcgatgcccg

SEQ ID NO: 3078 - RNA, 19 nt, synthetic construct
  source 1..19: mol_type = other RNA
ttctctggtggcgatgccc

SEQ ID NO: 3079 - RNA, 19 nt, synthetic construct
  source 1..19: mol_type = other RNA
gttctctggtggcgatgcc

SEQ ID NO: 3080 - RNA, 19 nt, synthetic construct
  source 1..19: mol_type = other RNA
cgttctctggtggcgatgc

SEQ ID NO: 3081 - RNA, 19 nt, synthetic construct
  source 1..19: mol_type = other RNA
ccgttctctggtggcgatg

SEQ ID NO: 3082 - RNA, 19 nt, synthetic construct
  source 1..19: mol_type = other RNA
gccgttctctggtggcgat

SEQ ID NO: 3083 - RNA, 19 nt, synthetic construct
  source 1..19: mol_type = other RNA
agccgttctctggtggcga

SEQ ID NO: 3084 - RNA, 19 nt, synthetic construct
  source 1..19: mol_type = other RNA
cagccgttctctggtggcg

SEQ ID NO: 3085 - RNA, 19 nt, synthetic construct
  source 1..19: mol_type = other RNA
ctgggccagccgttctctg

SEQ ID NO: 3086 - RNA, 19 nt, synthetic construct
  source 1..19: mol_type = other RNA
cctgggccagccgttctct

SEQ ID NO: 3087 - RNA, 19 nt, synthetic construct
  source 1..19: mol_type = other RNA
gcctgggccagccgttctc

SEQ ID NO: 3088 - RNA, 19 nt, synthetic construct
  source 1..19: mol_type = other RNA
ggcctgggccagccgttct

SEQ ID NO: 3089 - RNA, 19 nt, synthetic construct
  source 1..19: mol_type = other RNA
tggcctgggccagccgttc

SEQ ID NO: 3090 - RNA, 19 nt, synthetic construct
  source 1..19: mol_type = other RNA
gaatgccgatggcctgggc

SEQ ID NO: 3091 - RNA, 19 nt, synthetic construct
  source 1..19: mol_type = other RNA
ggaatgccgatggcctggg

SEQ ID NO: 3092 - RNA, 19 nt, synthetic construct
  source 1..19: mol_type = other RNA
cggaatgccgatggcctgg

SEQ ID NO: 3093 - RNA, 19 nt, synthetic construct
  source 1..19: mol_type = other RNA
ccggaatgccgatggcctg

SEQ ID NO: 3094 - RNA, 19 nt, synthetic construct
  source 1..19: mol_type = other RNA
tccggaatgccgatggcct

SEQ ID NO: 3095 - RNA, 19 nt, synthetic construct
  source 1..19: mol_type = other RNA
ctccggaatgccgatggcc

SEQ ID NO: 3096 - RNA, 19 nt, synthetic construct
  source 1..19: mol_type = other RNA
gctccggaatgccgatggc

SEQ ID NO: 3097 - RNA, 19 nt, synthetic construct
  source 1..19: mol_type = other RNA
ggctccggaatgccgatgg

SEQ ID NO: 3098 - RNA, 19 nt, synthetic construct
  source 1..19: mol_type = other RNA
gggctccggaatgccgatg

SEQ ID NO: 3099 - RNA, 19 nt, synthetic construct
  source 1..19: mol_type = other RNA
tgggctccggaatgccgat

SEQ ID NO: 3100 - RNA, 19 nt, synthetic construct
  source 1..19: mol_type = other RNA
ctgggctccggaatgccga

SEQ ID NO: 3101 - RNA, 19 nt, synthetic construct
  source 1..19: mol_type = other RNA
cctgggctccggaatgccg

SEQ ID NO: 3102 - RNA, 19 nt, synthetic construct
  source 1..19: mol_type = other RNA
ccctgggctccggaatgcc

SEQ ID NO: 3103 - RNA, 19 nt, synthetic construct
  source 1..19: mol_type = other RNA
accctgggctccggaatgc

SEQ ID NO: 3104 - RNA, 19 nt, synthetic construct
  source 1..19: mol_type = other RNA
gaccctgggctccggaatg

SEQ ID NO: 3105 - RNA, 19 nt, synthetic construct
  source 1..19: mol_type = other RNA
ggaccctgggctccggaat

SEQ ID NO: 3106 - RNA, 19 nt, synthetic construct
  source 1..19: mol_type = other RNA
tggaccctgggctccggaa

SEQ ID NO: 3107 - RNA, 19 nt, synthetic construct
  source 1..19: mol_type = other RNA
ctggaccctgggctccgga

SEQ ID NO: 3108 - RNA, 19 nt, synthetic construct
  source 1..19: mol_type = other RNA
tctggaccctgggctccgg

SEQ ID NO: 3109 - RNA, 19 nt, synthetic construct
  source 1..19: mol_type = other RNA
atctggaccctgggctccg

SEQ ID NO: 3110 - RNA, 19 nt, synthetic construct
  source 1..19: mol_type = other RNA
aatctggaccctgggctcc

SEQ ID NO: 3111 - RNA, 19 nt, synthetic construct
  source 1..19: mol_type = other RNA
ctgaaaccaaatctggacc

SEQ ID NO: 3112 - RNA, 19 nt, synthetic construct
  source 1..19: mol_type = other RNA
tctgaaaccaaatctggac

SEQ ID NO: 3113 - RNA, 19 nt, synthetic construct
  source 1..19: mol_type = other RNA
ttctgaaaccaaatctgga

SEQ ID NO: 3114 - RNA, 19 nt, synthetic construct
  source 1..19: mol_type = other RNA
attctgaaaccaaatctgg

SEQ ID NO: 3115 - RNA, 19 nt, synthetic construct
  source 1..19: mol_type = other RNA
cattctgaaaccaaatctg

SEQ ID NO: 3116 - RNA, 19 nt, synthetic construct
  source 1..19: mol_type = other RNA
ctcattctgaaaccaaatc

SEQ ID NO: 3117 - RNA, 19 nt, synthetic construct
  source 1..19: mol_type = other RNA
ctctcattctgaaaccaaa

SEQ ID NO: 3118 - RNA, 19 nt, synthetic construct
  source 1..19: mol_type = other RNA
cctctcattctgaaaccaa

SEQ ID NO: 3119 - RNA, 19 nt, synthetic construct
  source 1..19: mol_type = other RNA
acctctcattctgaaacca

SEQ ID NO: 3120 - RNA, 19 nt, synthetic construct
  source 1..19: mol_type = other RNA
gacctctcattctgaaacc

SEQ ID NO: 3121 - RNA, 19 nt, synthetic construct
  source 1..19: mol_type = other RNA
tgacctctcattctgaaac

SEQ ID NO: 3122 - RNA, 19 nt, synthetic construct
  source 1..19: mol_type = other RNA
gtgacctctcattctgaaa

SEQ ID NO: 3123 - RNA, 19 nt, synthetic construct
  source 1..19: mol_type = other RNA
cgtgacctctcattctgaa

SEQ ID NO: 3124 - RNA, 19 nt, synthetic construct
  source 1..19: mol_type = other RNA
gcgtgacctctcattctga

SEQ ID NO: 3125 - RNA, 19 nt, synthetic construct
  source 1..19: mol_type = other RNA
ggcgtgacctctcattctg

SEQ ID NO: 3126 - RNA, 19 nt, synthetic construct
  source 1..19: mol_type = other RNA
tggcgtgacctctcattct

SEQ ID NO: 3127 - RNA, 19 nt, synthetic construct
  source 1..19: mol_type = other RNA
ctggcgtgacctctcattc

SEQ ID NO: 3128 - RNA, 19 nt, synthetic construct
  source 1..19: mol_type = other RNA
gctggcgtgacctctcatt

SEQ ID NO: 3129 - RNA, 19 nt, synthetic construct
  source 1..19: mol_type = other RNA
agctggcgtgacctctcat

SEQ ID NO: 3130 - RNA, 19 nt, synthetic construct
  source 1..19: mol_type = other RNA
cagctggcgtgacctctca

SEQ ID NO: 3131 - RNA, 19 nt, synthetic construct
  source 1..19: mol_type = other RNA
tcagctggcgtgacctctc

SEQ ID NO: 3132 - RNA, 19 nt, synthetic construct
  source 1..19: mol_type = other RNA
ctcagctggcgtgacctct

SEQ ID NO: 3133 - RNA, 19 nt, synthetic construct
  source 1..19: mol_type = other RNA
cctcagctggcgtgacctc

SEQ ID NO: 3134 - RNA, 19 nt, synthetic construct
  source 1..19: mol_type = other RNA
gcctcagctggcgtgacct

SEQ ID NO: 3135 - RNA, 19 nt, synthetic construct
  source 1..19: mol_type = other RNA
tgcctcagctggcgtgacc

SEQ ID NO: 3136 - RNA, 19 nt, synthetic construct
  source 1..19: mol_type = other RNA
ctgcctcagctggcgtgac

SEQ ID NO: 3137 - RNA, 19 nt, synthetic construct
  source 1..19: mol_type = other RNA
gctgcctcagctggcgtga

SEQ ID NO: 3138 - RNA, 19 nt, synthetic construct
  source 1..19: mol_type = other RNA
tgctgcctcagctggcgtg

SEQ ID NO: 3139 - RNA, 19 nt, synthetic construct
  source 1..19: mol_type = other RNA
tcccgccggtgctgcctca

SEQ ID NO: 3140 - RNA, 19 nt, synthetic construct
  source 1..19: mol_type = other RNA
ttcccgccggtgctgcctc

SEQ ID NO: 3141 - RNA, 19 nt, synthetic construct
  source 1..19: mol_type = other RNA
attcccgccggtgctgcct

SEQ ID NO: 3142 - RNA, 19 nt, synthetic construct
  source 1..19: mol_type = other RNA
gattcccgccggtgctgcc

SEQ ID NO: 3143 - RNA, 19 nt, synthetic construct
  source 1..19: mol_type = other RNA
agattcccgccggtgctgc

SEQ ID NO: 3144 - RNA, 19 nt, synthetic construct
  source 1..19: mol_type = other RNA
gagattcccgccggtgctg

SEQ ID NO: 3145 - RNA, 19 nt, synthetic construct
  source 1..19: mol_type = other RNA
cgagattcccgccggtgct

SEQ ID NO: 3146 - RNA, 19 nt, synthetic construct
  source 1..19: mol_type = other RNA
ccgagattcccgccggtgc

SEQ ID NO: 3147 - RNA, 19 nt, synthetic construct
  source 1..19: mol_type = other RNA
gccgagattcccgccggtg

SEQ ID NO: 3148 - RNA, 19 nt, synthetic construct
  source 1..19: mol_type = other RNA
agggccgagattcccgccg

SEQ ID NO: 3149 - RNA, 19 nt, synthetic construct
  source 1..19: mol_type = other RNA
cagggccgagattcccgcc

SEQ ID NO: 3150 - RNA, 19 nt, synthetic construct
  source 1..19: mol_type = other RNA
ccagggccgagattcccgc

SEQ ID NO: 3151 - RNA, 19 nt, synthetic construct
  source 1..19: mol_type = other RNA
gccagggccgagattcccg

SEQ ID NO: 3152 - RNA, 19 nt, synthetic construct
  source 1..19: mol_type = other RNA
ggccagggccgagattccc

SEQ ID NO: 3153 - RNA, 19 nt, synthetic construct
  source 1..19: mol_type = other RNA
gggccagggccgagattcc

SEQ ID NO: 3154 - RNA, 19 nt, synthetic construct
  source 1..19: mol_type = other RNA
cgggccagggccgagattc

SEQ ID NO: 3155 - RNA, 19 nt, synthetic construct
  source 1..19: mol_type = other RNA
ttctggcgggccgcgtctc

SEQ ID NO: 3156 - RNA, 19 nt, synthetic construct
  source 1..19: mol_type = other RNA
cttctggcgggccgcgtct

SEQ ID NO: 3157 - RNA, 19 nt, synthetic construct
  source 1..19: mol_type = other RNA
ctttcgccggccttctggc

SEQ ID NO: 3158 - RNA, 19 nt, synthetic construct
  source 1..19: mol_type = other RNA
gctttcgccggccttctgg

SEQ ID NO: 3159 - RNA, 19 nt, synthetic construct
  source 1..19: mol_type = other RNA
cgctttcgccggccttctg

SEQ ID NO: 3160 - RNA, 19 nt, synthetic construct
  source 1..19: mol_type = other RNA
ccgctttcgccggccttct

SEQ ID NO: 3161 - RNA, 19 nt, synthetic construct
  source 1..19: mol_type = other RNA
tccgctttcgccggccttc

SEQ ID NO: 3162 - RNA, 19 nt, synthetic construct
  source 1..19: mol_type = other RNA
gtccgctttcgccggcctt

SEQ ID NO: 3163 - RNA, 19 nt, synthetic construct
  source 1..19: mol_type = other RNA
gacggcggtccgctttcgc

SEQ ID NO: 3164 - RNA, 19 nt, synthetic construct
  source 1..19: mol_type = other RNA
tgacggcggtccgctttcg

SEQ ID NO: 3165 - RNA, 19 nt, synthetic construct
  source 1..19: mol_type = other RNA
gtgacggcggtccgctttc

SEQ ID NO: 3166 - RNA, 19 nt, synthetic construct
  source 1..19: mol_type = other RNA
ggtgacggcggtccgcttt

SEQ ID NO: 3167 - RNA, 19 nt, synthetic construct
  source 1..19: mol_type = other RNA
cggtgacggcggtccgctt

SEQ ID NO: 3168 - RNA, 19 nt, synthetic construct
  source 1..19: mol_type = other RNA
atccggtgacggcggtccg

SEQ ID NO: 3169 - RNA, 19 nt, synthetic construct
  source 1..19: mol_type = other RNA
gatccggtgacggcggtcc

SEQ ID NO: 3170 - RNA, 19 nt, synthetic construct
  source 1..19: mol_type = other RNA
ggatccggtgacggcggtc

SEQ ID NO: 3171 - RNA, 19 nt, synthetic construct
  source 1..19: mol_type = other RNA
gggatccggtgacggcggt

SEQ ID NO: 3172 - RNA, 19 nt, synthetic construct
  source 1..19: mol_type = other RNA
tgggatccggtgacggcgg

SEQ ID NO: 3173 - RNA, 19 nt, synthetic construct
  source 1..19: mol_type = other RNA
ctgggatccggtgacggcg

SEQ ID NO: 3174 - RNA, 19 nt, synthetic construct
  source 1..19: mol_type = other RNA
tctgggatccggtgacggc

SEQ ID NO: 3175 - RNA, 19 nt, synthetic construct
  source 1..19: mol_type = other RNA
gtctgggatccggtgacgg

SEQ ID NO: 3176 - RNA, 19 nt, synthetic construct
  source 1..19: mol_type = other RNA
ggtctgggatccggtgacg

SEQ ID NO: 3177 - RNA, 19 nt, synthetic construct
  source 1..19: mol_type = other RNA
cggtctgggatccggtgac

SEQ ID NO: 3178 - RNA, 19 nt, synthetic construct
  source 1..19: mol_type = other RNA
gcggtctgggatccggtga

SEQ ID NO: 3179 - RNA, 19 nt, synthetic construct
  source 1..19: mol_type = other RNA
ggcggtctgggatccggtg

SEQ ID NO: 3180 - RNA, 19 nt, synthetic construct
  source 1..19: mol_type = other RNA
gggcggtctgggatccggt

SEQ ID NO: 3181 - RNA, 19 nt, synthetic construct
  source 1..19: mol_type = other RNA
agggcggtctgggatccgg

SEQ ID NO: 3182 - RNA, 19 nt, synthetic construct
  source 1..19: mol_type = other RNA
cagggcggtctgggatccg

SEQ ID NO: 3183 - RNA, 19 nt, synthetic construct
  source 1..19: mol_type = other RNA
gcagggcggtctgggatcc

SEQ ID NO: 3184 - RNA, 19 nt, synthetic construct
  source 1..19: mol_type = other RNA
agcagggcggtctgggatc

SEQ ID NO: 3185 - RNA, 19 nt, synthetic construct
  source 1..19: mol_type = other RNA
gagcagggcggtctgggat

SEQ ID NO: 3186 - RNA, 19 nt, synthetic construct
  source 1..19: mol_type = other RNA
ggagcagggcggtctggga

SEQ ID NO: 3187 - RNA, 19 nt, synthetic construct
  source 1..19: mol_type = other RNA
aggagcagggcggtctggg

SEQ ID NO: 3188 - RNA, 19 nt, synthetic construct
  source 1..19: mol_type = other RNA
gaggagcagggcggtctgg

SEQ ID NO: 3189 - RNA, 19 nt, synthetic construct
  source 1..19: mol_type = other RNA
ggaggagcagggcggtctg

SEQ ID NO: 3190 - RNA, 19 nt, synthetic construct
  source 1..19: mol_type = other RNA
cggaggagcagggcggtct

SEQ ID NO: 3191 - RNA, 19 nt, synthetic construct
  source 1..19: mol_type = other RNA
tcggaggagcagggcggtc

SEQ ID NO: 3192 - RNA, 19 nt, synthetic construct
  source 1..19: mol_type = other RNA
ctcggaggagcagggcggt

SEQ ID NO: 3193 - RNA, 19 nt, synthetic construct
  source 1..19: mol_type = other RNA
tctcaaaggctcggaggag

SEQ ID NO: 3194 - RNA, 19 nt, synthetic construct
  source 1..19: mol_type = other RNA
ccttctcaaaggctcggag

SEQ ID NO: 3195 - RNA, 19 nt, synthetic construct
  source 1..19: mol_type = other RNA
aaagcgatccttctcaaag

SEQ ID NO: 3196 - RNA, 19 nt, synthetic construct
  source 1..19: mol_type = other RNA
gaaagcgatccttctcaaa

SEQ ID NO: 3197 - RNA, 19 nt, synthetic construct
  source 1..19: mol_type = other RNA
ggaaagcgatccttctcaa

SEQ ID NO: 3198 - RNA, 19 nt, synthetic construct
  source 1..19: mol_type = other RNA
tggaaagcgatccttctca

SEQ ID NO: 3199 - RNA, 19 nt, synthetic construct
  source 1..19: mol_type = other RNA
ctggaaagcgatccttctc

SEQ ID NO: 3200 - RNA, 19 nt, synthetic construct
  source 1..19: mol_type = other RNA
cctggaaagcgatccttct

SEQ ID NO: 3201 - RNA, 19 nt, synthetic construct
  source 1..19: mol_type = other RNA
gcctggaaagcgatccttc

SEQ ID NO: 3202 - RNA, 19 nt, synthetic construct
  source 1..19: mol_type = other RNA
tgcctggaaagcgatcctt

SEQ ID NO: 3203 - RNA, 19 nt, synthetic construct
  source 1..19: mol_type = other RNA
atgcctggaaagcgatcct

SEQ ID NO: 3204 - RNA, 19 nt, synthetic construct
  source 1..19: mol_type = other RNA
gatgcctggaaagcgatcc

SEQ ID NO: 3205 - RNA, 19 nt, synthetic construct
  source 1..19: mol_type = other RNA
cgatgcctggaaagcgatc

SEQ ID NO: 3206 - RNA, 19 nt, synthetic construct
  source 1..19: mol_type = other RNA
gcgatgcctggaaagcgat

SEQ ID NO: 3207 - RNA, 19 nt, synthetic construct
  source 1..19: mol_type = other RNA
ggcgatgcctggaaagcga

SEQ ID NO: 3208 - RNA, 19 nt, synthetic construct
  source 1..19: mol_type = other RNA
cggcgatgcctggaaagcg

SEQ ID NO: 3209 - RNA, 19 nt, synthetic construct
  source 1..19: mol_type = other RNA
gcggcgatgcctggaaagc

SEQ ID NO: 3210 - RNA, 19 nt, synthetic construct
  source 1..19: mol_type = other RNA
ggcggcgatgcctggaaag

SEQ ID NO: 3211 - RNA, 19 nt, synthetic construct
  source 1..19: mol_type = other RNA
gggcggcgatgcctggaaa

SEQ ID NO: 3212 - RNA, 19 nt, synthetic construct
  source 1..19: mol_type = other RNA
cgggcggcgatgcctggaa

SEQ ID NO: 3213 - RNA, 19 nt, synthetic construct
  source 1..19: mol_type = other RNA
tctggccagctcctcccgg

SEQ ID NO: 3214 - RNA, 19 nt, synthetic construct
  source 1..19: mol_type = other RNA
ctctggccagctcctcccg

SEQ ID NO: 3215 - RNA, 19 nt, synthetic construct
  source 1..19: mol_type = other RNA
tctctggccagctcctccc

SEQ ID NO: 3216 - RNA, 19 nt, synthetic construct
  source 1..19: mol_type = other RNA
ctctctggccagctcctcc

SEQ ID NO: 3217 - RNA, 19 nt, synthetic construct
  source 1..19: mol_type = other RNA
tctctctggccagctcctc

SEQ ID NO: 3218 - RNA, 19 nt, synthetic construct
  source 1..19: mol_type = other RNA
gtctctctggccagctcct

SEQ ID NO: 3219 - RNA, 19 nt, synthetic construct
  source 1..19: mol_type = other RNA
cgtctctctggccagctcc

SEQ ID NO: 3220 - RNA, 19 nt, synthetic construct
  source 1..19: mol_type = other RNA
ccgtctctctggccagctc

SEQ ID NO: 3221 - RNA, 19 nt, synthetic construct
  source 1..19: mol_type = other RNA
cccgtctctctggccagct

SEQ ID NO: 3222 - RNA, 19 nt, synthetic construct
  source 1..19: mol_type = other RNA
gcccgtctctctggccagc

SEQ ID NO: 3223 - RNA, 19 nt, synthetic construct
  source 1..19: mol_type = other RNA
ggaggcccgtctctctggc

SEQ ID NO: 3224 - RNA, 19 nt, synthetic construct
  source 1..19: mol_type = other RNA
gggaggcccgtctctctgg

SEQ ID NO: 3225 - RNA, 19 nt, synthetic construct
  source 1..19: mol_type = other RNA
cgggaggcccgtctctctg

SEQ ID NO: 3226 - RNA, 19 nt, synthetic construct
  source 1..19: mol_type = other RNA
ccgggaggcccgtctctct

SEQ ID NO: 3227 - RNA, 19 nt, synthetic construct
  source 1..19: mol_type = other RNA
tcctggactccgggaggcc

SEQ ID NO: 3228 - RNA, 19 nt, synthetic construct
  source 1..19: mol_type = other RNA
atcctggactccgggaggc

SEQ ID NO: 3229 - RNA, 19 nt, synthetic construct
  source 1..19: mol_type = other RNA
aatcctggactccgggagg

SEQ ID NO: 3230 - RNA, 19 nt, synthetic construct
  source 1..19: mol_type = other RNA
gaatcctggactccgggag

SEQ ID NO: 3231 - RNA, 19 nt, synthetic construct
  source 1..19: mol_type = other RNA
tgaatcctggactccggga

SEQ ID NO: 3232 - RNA, 19 nt, synthetic construct
  source 1..19: mol_type = other RNA
ctgaatcctggactccggg

SEQ ID NO: 3233 - RNA, 19 nt, synthetic construct
  source 1..19: mol_type = other RNA
tctgaatcctggactccgg

SEQ ID NO: 3234 - RNA, 19 nt, synthetic construct
  source 1..19: mol_type = other RNA
atctgaatcctggactccg

SEQ ID NO: 3235 - RNA, 19 nt, synthetic construct
  source 1..19: mol_type = other RNA
gatctgaatcctggactcc

SEQ ID NO: 3236 - RNA, 19 nt, synthetic construct
  source 1..19: mol_type = other RNA
agatctgaatcctggactc

SEQ ID NO: 3237 - RNA, 19 nt, synthetic construct
  source 1..19: mol_type = other RNA
cagatctgaatcctggact

SEQ ID NO: 3238 - RNA, 19 nt, synthetic construct
  source 1..19: mol_type = other RNA
aaaccagatctgaatcctg

SEQ ID NO: 3239 - RNA, 19 nt, synthetic construct
  source 1..19: mol_type = other RNA
gaaaccagatctgaatcct

SEQ ID NO: 3240 - RNA, 19 nt, synthetic construct
  source 1..19: mol_type = other RNA
tgaaaccagatctgaatcc

SEQ ID NO: 3241 - RNA, 19 nt, synthetic construct
  source 1..19: mol_type = other RNA
ctgaaaccagatctgaatc

SEQ ID NO: 3242 - RNA, 19 nt, synthetic construct
  source 1..19: mol_type = other RNA
tctgaaaccagatctgaat

SEQ ID NO: 3243 - RNA, 19 nt, synthetic construct
  source 1..19: mol_type = other RNA
ccttcgattctgaaaccag

SEQ ID NO: 3244 - RNA, 19 nt, synthetic construct
  source 1..19: mol_type = other RNA
cccttcgattctgaaacca

SEQ ID NO: 3245 - RNA, 19 nt, synthetic construct
  source 1..19: mol_type = other RNA
gcccttcgattctgaaacc

SEQ ID NO: 3246 - RNA, 19 nt, synthetic construct
  source 1..19: mol_type = other RNA
ggcccttcgattctgaaac

SEQ ID NO: 3247 - RNA, 19 nt, synthetic construct
  source 1..19: mol_type = other RNA
tggcccttcgattctgaaa

SEQ ID NO: 3248 - RNA, 19 nt, synthetic construct
  source 1..19: mol_type = other RNA
ctggcccttcgattctgaa

SEQ ID NO: 3249 - RNA, 19 nt, synthetic construct
  source 1..19: mol_type = other RNA
cctggcccttcgattctga

SEQ ID NO: 3250 - RNA, 19 nt, synthetic construct
  source 1..19: mol_type = other RNA
gcctggcccttcgattctg

SEQ ID NO: 3251 - RNA, 19 nt, synthetic construct
  source 1..19: mol_type = other RNA
tgcctggcccttcgattct

SEQ ID NO: 3252 - RNA, 19 nt, synthetic construct
  source 1..19: mol_type = other RNA
gtgcctggcccttcgattc

SEQ ID NO: 3253 - RNA, 19 nt, synthetic construct
  source 1..19: mol_type = other RNA
ggtgcctggcccttcgatt

SEQ ID NO: 3254 - RNA, 19 nt, synthetic construct
  source 1..19: mol_type = other RNA
gggtgcctggcccttcgat

SEQ ID NO: 3255 - RNA, 19 nt, synthetic construct
  source 1..19: mol_type = other RNA
cgggtgcctggcccttcga

SEQ ID NO: 3256 - RNA, 19 nt, synthetic construct
  source 1..19: mol_type = other RNA
gagggagcagggtgacccc

SEQ ID NO: 3257 - RNA, 19 nt, synthetic construct
  source 1..19: mol_type = other RNA
cgagggagcagggtgaccc

SEQ ID NO: 3258 - RNA, 19 nt, synthetic construct
  source 1..19: mol_type = other RNA
acgagggagcagggtgacc

SEQ ID NO: 3259 - RNA, 19 nt, synthetic construct
  source 1..19: mol_type = other RNA
cacgagggagcagggtgac

SEQ ID NO: 3260 - RNA, 19 nt, synthetic construct
  source 1..19: mol_type = other RNA
ccacgagggagcagggtga

SEQ ID NO: 3261 - RNA, 19 nt, synthetic construct
  source 1..19: mol_type = other RNA
cccacgagggagcagggtg

SEQ ID NO: 3262 - RNA, 19 nt, synthetic construct
  source 1..19: mol_type = other RNA
gtgtgggcgaaggcgaccc

SEQ ID NO: 3263 - RNA, 19 nt, synthetic construct
  source 1..19: mol_type = other RNA
ggtgtgggcgaaggcgacc

SEQ ID NO: 3264 - RNA, 19 nt, synthetic construct
  source 1..19: mol_type = other RNA
cggtgtgggcgaaggcgac

SEQ ID NO: 3265 - RNA, 19 nt, synthetic construct
  source 1..19: mol_type = other RNA
ccggtgtgggcgaaggcga

SEQ ID NO: 3266 - RNA, 19 nt, synthetic construct
  source 1..19: mol_type = other RNA
ttccccacgcgccggtgtg

SEQ ID NO: 3267 - RNA, 19 nt, synthetic construct
  source 1..19: mol_type = other RNA
gttccccacgcgccggtgt

SEQ ID NO: 3268 - RNA, 19 nt, synthetic construct
  source 1..19: mol_type = other RNA
aagccccgttccccacgcg

SEQ ID NO: 3269 - RNA, 19 nt, synthetic construct
  source 1..19: mol_type = other RNA
gaagccccgttccccacgc

SEQ ID NO: 3270 - RNA, 19 nt, synthetic construct
  source 1..19: mol_type = other RNA
acgtggggtgcgggaagcc

SEQ ID NO: 3271 - RNA, 19 nt, synthetic construct
  source 1..19: mol_type = other RNA
cacgtggggtgcgggaagc

SEQ ID NO: 3272 - RNA, 19 nt, synthetic construct
  source 1..19: mol_type = other RNA
tcgctgcctggctcacgaa

SEQ ID NO: 3273 - RNA, 19 nt, synthetic construct
  source 1..19: mol_type = other RNA
ctcgctgcctggctcacga

SEQ ID NO: 3274 - RNA, 19 nt, synthetic construct
  source 1..19: mol_type = other RNA
cctcgctgcctggctcacg

SEQ ID NO: 3275 - RNA, 19 nt, synthetic construct
  source 1..19: mol_type = other RNA
ccctcgctgcctggctcac

SEQ ID NO: 3276 - RNA, 19 nt, synthetic construct
  source 1..19: mol_type = other RNA
gagatcccctctgccggcg

SEQ ID NO: 3277 - RNA, 19 nt, synthetic construct
  source 1..19: mol_type = other RNA
ggagatcccctctgccggc

SEQ ID NO: 3278 - RNA, 19 nt, synthetic construct
  source 1..19: mol_type = other RNA
gggagatcccctctgccgg

SEQ ID NO: 3279 - RNA, 19 nt, synthetic construct
  source 1..19: mol_type = other RNA
tgggagatcccctctgccg

SEQ ID NO: 3280 - RNA, 19 nt, synthetic construct
  source 1..19: mol_type = other RNA
ttgggagatcccctctgcc

SEQ ID NO: 3281 - RNA, 19 nt, synthetic construct
  source 1..19: mol_type = other RNA
ggggcaggttgggagatcc

SEQ ID NO: 3282 - RNA, 19 nt, synthetic construct
  source 1..19: mol_type = other RNA
cggggcaggttgggagatc

SEQ ID NO: 3283 - RNA, 19 nt, synthetic construct
  source 1..19: mol_type = other RNA
ccggggcaggttgggagat

SEQ ID NO: 3284 - RNA, 19 nt, synthetic construct
  source 1..19: mol_type = other RNA
gccggggcaggttgggaga

SEQ ID NO: 3285 - RNA, 19 nt, synthetic construct
  source 1..19: mol_type = other RNA
cgtaggcgaaatccccgcg

SEQ ID NO: 3286 - RNA, 19 nt, synthetic construct
  source 1..19: mol_type = other RNA
gcgtaggcgaaatccccgc

SEQ ID NO: 3287 - RNA, 19 nt, synthetic construct
  source 1..19: mol_type = other RNA
ggcgtaggcgaaatccccg

SEQ ID NO: 3288 - RNA, 19 nt, synthetic construct
  source 1..19: mol_type = other RNA
cggcgtaggcgaaatcccc

SEQ ID NO: 3289 - RNA, 19 nt, synthetic construct
  source 1..19: mol_type = other RNA
gcggcgtaggcgaaatccc

SEQ ID NO: 3290 - RNA, 19 nt, synthetic construct
  source 1..19: mol_type = other RNA
ggcggcgtaggcgaaatcc

SEQ ID NO: 3291 - RNA, 19 nt, synthetic construct
  source 1..19: mol_type = other RNA
gggcggcgtaggcgaaatc

SEQ ID NO: 3292 - RNA, 19 nt, synthetic construct
  source 1..19: mol_type = other RNA
ggggcggcgtaggcgaaat

SEQ ID NO: 3293 - RNA, 19 nt, synthetic construct
  source 1..19: mol_type = other RNA
cggggcggcgtaggcgaaa

SEQ ID NO: 3294 - RNA, 19 nt, synthetic construct
  source 1..19: mol_type = other RNA
tgagggtgggagagcgccc

SEQ ID NO: 3295 - RNA, 19 nt, synthetic construct
  source 1..19: mol_type = other RNA
ctgagggtgggagagcgcc

SEQ ID NO: 3296 - RNA, 19 nt, synthetic construct
  source 1..19: mol_type = other RNA
cctgagggtgggagagcgc

SEQ ID NO: 3297 - RNA, 19 nt, synthetic construct
  source 1..19: mol_type = other RNA
gcctgagggtgggagagcg

SEQ ID NO: 3298 - RNA, 19 nt, synthetic construct
  source 1..19: mol_type = other RNA
agcctgagggtgggagagc

SEQ ID NO: 3299 - RNA, 19 nt, synthetic construct
  source 1..19: mol_type = other RNA
gagcctgagggtgggagag

SEQ ID NO: 3300 - RNA, 19 nt, synthetic construct
  source 1..19: mol_type = other RNA
ggagcctgagggtgggaga

SEQ ID NO: 3301 - RNA, 19 nt, synthetic construct
  source 1..19: mol_type = other RNA
aggagcctgagggtgggag

SEQ ID NO: 3302 - RNA, 19 nt, synthetic construct
  source 1..19: mol_type = other RNA
gaggagcctgagggtggga

SEQ ID NO: 3303 - RNA, 19 nt, synthetic construct
  source 1..19: mol_type = other RNA
cgaggagcctgagggtggg

SEQ ID NO: 3304 - RNA, 19 nt, synthetic construct
  source 1..19: mol_type = other RNA
ccgaggagcctgagggtgg

SEQ ID NO: 3305 - RNA, 19 nt, synthetic construct
  source 1..19: mol_type = other RNA
accgaggagcctgagggtg

SEQ ID NO: 3306 - RNA, 19 nt, synthetic construct
  source 1..19: mol_type = other RNA
caccgaggagcctgagggt

SEQ ID NO: 3307 - RNA, 19 nt, synthetic construct
  source 1..19: mol_type = other RNA
ccaccgaggagcctgaggg

SEQ ID NO: 3308 - RNA, 19 nt, synthetic construct
  source 1..19: mol_type = other RNA
gccaccgaggagcctgagg

SEQ ID NO: 3309 - RNA, 19 nt, synthetic construct
  source 1..19: mol_type = other RNA
ggccaccgaggagcctgag

SEQ ID NO: 3310 - RNA, 19 nt, synthetic construct
  source 1..19: mol_type = other RNA
tgcggaggccaccgaggag

SEQ ID NO: 3311 - RNA, 19 nt, synthetic construct
  source 1..19: mol_type = other RNA
gtgcggaggccaccgagga

SEQ ID NO: 3312 - RNA, 19 nt, synthetic construct
  source 1..19: mol_type = other RNA
tttgcccgggtgcggaggc

SEQ ID NO: 3313 - RNA, 19 nt, synthetic construct
  source 1..19: mol_type = other RNA
ttttgcccgggtgcggagg

SEQ ID NO: 3314 - RNA, 19 nt, synthetic construct
  source 1..19: mol_type = other RNA
cttttgcccgggtgcggag

SEQ ID NO: 3315 - RNA, 19 nt, synthetic construct
  source 1..19: mol_type = other RNA
gcttttgcccgggtgcgga

SEQ ID NO: 3316 - RNA, 19 nt, synthetic construct
  source 1..19: mol_type = other RNA
ggcttttgcccgggtgcgg

SEQ ID NO: 3317 - RNA, 19 nt, synthetic construct
  source 1..19: mol_type = other RNA
cggcttttgcccgggtgcg

SEQ ID NO: 3318 - RNA, 19 nt, synthetic construct
  source 1..19: mol_type = other RNA
tcctcccggcttttgcccg

SEQ ID NO: 3319 - RNA, 19 nt, synthetic construct
  source 1..19: mol_type = other RNA
gtcctcccggcttttgccc

SEQ ID NO: 3320 - RNA, 19 nt, synthetic construct
  source 1..19: mol_type = other RNA
ggtcctcccggcttttgcc

SEQ ID NO: 3321 - RNA, 19 nt, synthetic construct
  source 1..19: mol_type = other RNA
cggtcctcccggcttttgc

SEQ ID NO: 3322 - RNA, 19 nt, synthetic construct
  source 1..19: mol_type = other RNA
aggctgtgccaccgcgcag

SEQ ID NO: 3323 - RNA, 19 nt, synthetic construct
  source 1..19: mol_type = other RNA
caggctgtgccaccgcgca

SEQ ID NO: 3324 - RNA, 19 nt, synthetic construct
  source 1..19: mol_type = other RNA
tgagcgggcccaggctgtg

SEQ ID NO: 3325 - RNA, 19 nt, synthetic construct
  source 1..19: mol_type = other RNA
ttgagcgggcccaggctgt

SEQ ID NO: 3326 - RNA, 19 nt, synthetic construct
  source 1..19: mol_type = other RNA
cttgagcgggcccaggctg

SEQ ID NO: 3327 - RNA, 19 nt, synthetic construct
  source 1..19: mol_type = other RNA
gcttgagcgggcccaggct

SEQ ID NO: 3328 - RNA, 19 nt, synthetic construct
  source 1..19: mol_type = other RNA
agcaccccttggccctgcg

SEQ ID NO: 3329 - RNA, 19 nt, synthetic construct
  source 1..19: mol_type = other RNA
aagcaccccttggccctgc

SEQ ID NO: 3330 - RNA, 19 nt, synthetic construct
  source 1..19: mol_type = other RNA
tcccctgggacgtgggtgg

SEQ ID NO: 3331 - RNA, 19 nt, synthetic construct
  source 1..19: mol_type = other RNA
ctcccctgggacgtgggtg

SEQ ID NO: 3332 - RNA, 19 nt, synthetic construct
  source 1..19: mol_type = other RNA
actcccctgggacgtgggt

SEQ ID NO: 3333 - RNA, 19 nt, synthetic construct
  source 1..19: mol_type = other RNA
caccacggactcccctggg

SEQ ID NO: 3334 - RNA, 19 nt, synthetic construct
  source 1..19: mol_type = other RNA
ccaccacggactcccctgg

SEQ ID NO: 3335 - RNA, 19 nt, synthetic construct
  source 1..19: mol_type = other RNA
cccaccacggactcccctg

SEQ ID NO: 3336 - RNA, 19 nt, synthetic construct
  source 1..19: mol_type = other RNA
ccccaccacggactcccct

SEQ ID NO: 3337 - RNA, 19 nt, synthetic construct
  source 1..19: mol_type = other RNA
ttggggttcccacgccgcc

SEQ ID NO: 3338 - RNA, 19 nt, synthetic construct
  source 1..19: mol_type = other RNA
tggagctgccccggcttgg

SEQ ID NO: 3339 - RNA, 19 nt, synthetic construct
  source 1..19: mol_type = other RNA
gtggagctgccccggcttg

SEQ ID NO: 3340 - RNA, 19 nt, synthetic construct
  source 1..19: mol_type = other RNA
ggtggagctgccccggctt

SEQ ID NO: 3341 - RNA, 19 nt, synthetic construct
  source 1..19: mol_type = other RNA
tggggaggtggagctgccc

SEQ ID NO: 3342 - RNA, 19 nt, synthetic construct
  source 1..19: mol_type = other RNA
ctggggaggtggagctgcc

SEQ ID NO: 3343 - RNA, 19 nt, synthetic construct
  source 1..19: mol_type = other RNA
gctggggaggtggagctgc

SEQ ID NO: 3344 - RNA, 19 nt, synthetic construct
  source 1..19: mol_type = other RNA
ggctggggaggtggagctg

SEQ ID NO: 3345 - RNA, 19 nt, synthetic construct
  source 1..19: mol_type = other RNA
tgcatctgcccctgccgcg

SEQ ID NO: 3346 - RNA, 19 nt, synthetic construct
  source 1..19: mol_type = other RNA
cttgcatctgcccctgccg

SEQ ID NO: 3347 - RNA, 19 nt, synthetic construct
  source 1..19: mol_type = other RNA
ccttgcatctgcccctgcc

SEQ ID NO: 3348 - RNA, 19 nt, synthetic construct
  source 1..19: mol_type = other RNA
gccttgcatctgcccctgc

SEQ ID NO: 3349 - RNA, 19 nt, synthetic construct
  source 1..19: mol_type = other RNA
tgccttgcatctgcccctg

SEQ ID NO: 3350 - RNA, 19 nt, synthetic construct
  source 1..19: mol_type = other RNA
atgccttgcatctgcccct

SEQ ID NO: 3351 - RNA, 19 nt, synthetic construct
  source 1..19: mol_type = other RNA
ggcgccgggatgccttgca

SEQ ID NO: 3352 - RNA, 19 nt, synthetic construct
  source 1..19: mol_type = other RNA
agggcgccgggatgccttg

SEQ ID NO: 3353 - RNA, 19 nt, synthetic construct
  source 1..19: mol_type = other RNA
gagggcgccgggatgcctt

SEQ ID NO: 3354 - RNA, 19 nt, synthetic construct
  source 1..19: mol_type = other RNA
tcctggagcgcctgggagg

SEQ ID NO: 3355 - RNA, 19 nt, synthetic construct
  source 1..19: mol_type = other RNA
gagtgcagaccagggcgcc

SEQ ID NO: 3356 - RNA, 19 nt, synthetic construct
  source 1..19: mol_type = other RNA
ggagtgcagaccagggcgc

SEQ ID NO: 3357 - RNA, 19 nt, synthetic construct
  source 1..19: mol_type = other RNA
gggagtgcagaccagggcg

SEQ ID NO: 3358 - RNA, 19 nt, synthetic construct
  source 1..19: mol_type = other RNA
ggggagtgcagaccagggc

SEQ ID NO: 3359 - RNA, 19 nt, synthetic construct
  source 1..19: mol_type = other RNA
aggggagtgcagaccaggg

SEQ ID NO: 3360 - RNA, 19 nt, synthetic construct
  source 1..19: mol_type = other RNA
caggggagtgcagaccagg

SEQ ID NO: 3361 - RNA, 19 nt, synthetic construct
  source 1..19: mol_type = other RNA
gcaggggagtgcagaccag

SEQ ID NO: 3362 - RNA, 19 nt, synthetic construct
  source 1..19: mol_type = other RNA
cgcaggggagtgcagacca

SEQ ID NO: 3363 - RNA, 19 nt, synthetic construct
  source 1..19: mol_type = other RNA
ccgcaggggagtgcagacc

SEQ ID NO: 3364 - RNA, 19 nt, synthetic construct
  source 1..19: mol_type = other RNA
gccgcaggggagtgcagac

SEQ ID NO: 3365 - RNA, 19 nt, synthetic construct
  source 1..19: mol_type = other RNA
ggccgcaggggagtgcaga

SEQ ID NO: 3366 - RNA, 19 nt, synthetic construct
  source 1..19: mol_type = other RNA
aggccgcaggggagtgcag

SEQ ID NO: 3367 - RNA, 19 nt, synthetic construct
  source 1..19: mol_type = other RNA
caggccgcaggggagtgca

SEQ ID NO: 3368 - RNA, 19 nt, synthetic construct
  source 1..19: mol_type = other RNA
agcaggccgcaggggagtg

SEQ ID NO: 3369 - RNA, 19 nt, synthetic construct
  source 1..19: mol_type = other RNA
cagcaggccgcaggggagt

SEQ ID NO: 3370 - RNA, 19 nt, synthetic construct
  source 1..19: mol_type = other RNA
tccagcagcaggccgcagg

SEQ ID NO: 3371 - RNA, 19 nt, synthetic construct
  source 1..19: mol_type = other RNA
atccagcagcaggccgcag

SEQ ID NO: 3372 - RNA, 19 nt, synthetic construct
  source 1..19: mol_type = other RNA
catccagcagcaggccgca

SEQ ID NO: 3373 - RNA, 19 nt, synthetic construct
  source 1..19: mol_type = other RNA
tcatccagcagcaggccgc

SEQ ID NO: 3374 - RNA, 19 nt, synthetic construct
  source 1..19: mol_type = other RNA
ctcatccagcagcaggccg

SEQ ID NO: 3375 - RNA, 19 nt, synthetic construct
  source 1..19: mol_type = other RNA
gctcatccagcagcaggcc

SEQ ID NO: 3376 - RNA, 19 nt, synthetic construct
  source 1..19: mol_type = other RNA
agctcatccagcagcaggc

SEQ ID NO: 3377 - RNA, 19 nt, synthetic construct
  source 1..19: mol_type = other RNA
gagctcatccagcagcagg

SEQ ID NO: 3378 - RNA, 19 nt, synthetic construct
  source 1..19: mol_type = other RNA
ggagctcatccagcagcag

SEQ ID NO: 3379 - RNA, 19 nt, synthetic construct
  source 1..19: mol_type = other RNA
aggagctcatccagcagca

SEQ ID NO: 3380 - RNA, 19 nt, synthetic construct
  source 1..19: mol_type = other RNA
caggagctcatccagcagc

SEQ ID NO: 3381 - RNA, 19 nt, synthetic construct
  source 1..19: mol_type = other RNA
ccaggagctcatccagcag

SEQ ID NO: 3382 - RNA, 19 nt, synthetic construct
  source 1..19: mol_type = other RNA
gccaggagctcatccagca

SEQ ID NO: 3383 - RNA, 19 nt, synthetic construct
  source 1..19: mol_type = other RNA
cgccaggagctcatccagc

SEQ ID NO: 3384 - RNA, 19 nt, synthetic construct
  source 1..19: mol_type = other RNA
aactccgggctcgccagga

SEQ ID NO: 3385 - RNA, 19 nt, synthetic construct
  source 1..19: mol_type = other RNA
aaactccgggctcgccagg

SEQ ID NO: 3386 - RNA, 19 nt, synthetic construct
  source 1..19: mol_type = other RNA
gaaactccgggctcgccag

SEQ ID NO: 3387 - RNA, 19 nt, synthetic construct
  source 1..19: mol_type = other RNA
ctgcagaaactccgggctc

SEQ ID NO: 3388 - RNA, 19 nt, synthetic construct
  source 1..19: mol_type = other RNA
gctgcagaaactccgggct

SEQ ID NO: 3389 - RNA, 19 nt, synthetic construct
  source 1..19: mol_type = other RNA
tgctgcagaaactccgggc

SEQ ID NO: 3390 - RNA, 19 nt, synthetic construct
  source 1..19: mol_type = other RNA
ctgctgcagaaactccggg

SEQ ID NO: 3391 - RNA, 19 nt, synthetic construct
  source 1..19: mol_type = other RNA
cctgctgcagaaactccgg

SEQ ID NO: 3392 - RNA, 19 nt, synthetic construct
  source 1..19: mol_type = other RNA
gcctgctgcagaaactccg

SEQ ID NO: 3393 - RNA, 19 nt, synthetic construct
  source 1..19: mol_type = other RNA
cgcctgctgcagaaactcc

SEQ ID NO: 3394 - RNA, 19 nt, synthetic construct
  source 1..19: mol_type = other RNA
gcgcctgctgcagaaactc

SEQ ID NO: 3395 - RNA, 19 nt, synthetic construct
  source 1..19: mol_type = other RNA
tgcgcctgctgcagaaact

SEQ ID NO: 3396 - RNA, 19 nt, synthetic construct
  source 1..19: mol_type = other RNA
ttgcgcctgctgcagaaac

SEQ ID NO: 3397 - RNA, 19 nt, synthetic construct
  source 1..19: mol_type = other RNA
gttgcgcctgctgcagaaa

SEQ ID NO: 3398 - RNA, 19 nt, synthetic construct
  source 1..19: mol_type = other RNA
ggttgcgcctgctgcagaa

SEQ ID NO: 3399 - RNA, 19 nt, synthetic construct
  source 1..19: mol_type = other RNA
aggttgcgcctgctgcaga

SEQ ID NO: 3400 - RNA, 19 nt, synthetic construct
  source 1..19: mol_type = other RNA
gaggttgcgcctgctgcag

SEQ ID NO: 3401 - RNA, 19 nt, synthetic construct
  source 1..19: mol_type = other RNA
agaggttgcgcctgctgca

SEQ ID NO: 3402 - RNA, 19 nt, synthetic construct
  source 1..19: mol_type = other RNA
gagaggttgcgcctgctgc

SEQ ID NO: 3403 - RNA, 19 nt, synthetic construct
  source 1..19: mol_type = other RNA
ggagaggttgcgcctgctg

SEQ ID NO: 3404 - RNA, 19 nt, synthetic construct
  source 1..19: mol_type = other RNA
aggagaggttgcgcctgct

SEQ ID NO: 3405 - RNA, 19 nt, synthetic construct
  source 1..19: mol_type = other RNA
taggagaggttgcgcctgc

SEQ ID NO: 3406 - RNA, 19 nt, synthetic construct
  source 1..19: mol_type = other RNA
ctaggagaggttgcgcctg

SEQ ID NO: 3407 - RNA, 19 nt, synthetic construct
  source 1..19: mol_type = other RNA
tctaggagaggttgcgcct

SEQ ID NO: 3408 - RNA, 19 nt, synthetic construct
  source 1..19: mol_type = other RNA
ttctaggagaggttgcgcc

SEQ ID NO: 3409 - RNA, 19 nt, synthetic construct
  source 1..19: mol_type = other RNA
tttctaggagaggttgcgc

SEQ ID NO: 3410 - RNA, 19 nt, synthetic construct
  source 1..19: mol_type = other RNA
gtttctaggagaggttgcg

SEQ ID NO: 3411 - RNA, 19 nt, synthetic construct
  source 1..19: mol_type = other RNA
cgtttctaggagaggttgc

SEQ ID NO: 3412 - RNA, 19 nt, synthetic construct
  source 1..19: mol_type = other RNA
ccgtttctaggagaggttg

SEQ ID NO: 3413 - RNA, 19 nt, synthetic construct
  source 1..19: mol_type = other RNA
tccgtttctaggagaggtt

SEQ ID NO: 3414 - RNA, 19 nt, synthetic construct
  source 1..19: mol_type = other RNA
ggggcctccgtttctagga

SEQ ID NO: 3415 - RNA, 19 nt, synthetic construct
  source 1..19: mol_type = other RNA
cggggcctccgtttctagg

SEQ ID NO: 3416 - RNA, 19 nt, synthetic construct
  source 1..19: mol_type = other RNA
ccggggcctccgtttctag

SEQ ID NO: 3417 - RNA, 19 nt, synthetic construct
  source 1..19: mol_type = other RNA
gagtggagtctctcaccgg

SEQ ID NO: 3418 - RNA, 19 nt, synthetic construct
  source 1..19: mol_type = other RNA
ggagtggagtctctcaccg

SEQ ID NO: 3419 - RNA, 19 nt, synthetic construct
  source 1..19: mol_type = other RNA
cggagtggagtctctcacc

SEQ ID NO: 3420 - RNA, 19 nt, synthetic construct
  source 1..19: mol_type = other RNA
tttcacggaagaacaaggg

SEQ ID NO: 3421 - RNA, 19 nt, synthetic construct
  source 1..19: mol_type = other RNA
atttcacggaagaacaagg

SEQ ID NO: 3422 - RNA, 19 nt, synthetic construct
  source 1..19: mol_type = other RNA
aatttcacggaagaacaag

SEQ ID NO: 3423 - RNA, 19 nt, synthetic construct
  source 1..19: mol_type = other RNA
gaatttcacggaagaacaa

SEQ ID NO: 3424 - RNA, 19 nt, synthetic construct
  source 1..19: mol_type = other RNA
agaatttcacggaagaaca

SEQ ID NO: 3425 - RNA, 19 nt, synthetic construct
  source 1..19: mol_type = other RNA
cagaatttcacggaagaac

SEQ ID NO: 3426 - RNA, 19 nt, synthetic construct
  source 1..19: mol_type = other RNA
ccagaatttcacggaagaa

SEQ ID NO: 3427 - RNA, 19 nt, synthetic construct
  source 1..19: mol_type = other RNA
gccagaatttcacggaaga

SEQ ID NO: 3428 - RNA, 19 nt, synthetic construct
  source 1..19: mol_type = other RNA
agccagaatttcacggaag

SEQ ID NO: 3429 - RNA, 19 nt, synthetic construct
  source 1..19: mol_type = other RNA
gggagacattcagccagaa

SEQ ID NO: 3430 - RNA, 19 nt, synthetic construct
  source 1..19: mol_type = other RNA
ggggagacattcagccaga

SEQ ID NO: 3431 - RNA, 19 nt, synthetic construct
  source 1..19: mol_type = other RNA
ggtttgcctagacagcgtc

SEQ ID NO: 3432 - RNA, 19 nt, synthetic construct
  source 1..19: mol_type = other RNA
aggtttgcctagacagcgt

SEQ ID NO: 3433 - RNA, 19 nt, synthetic construct
  source 1..19: mol_type = other RNA
caggtttgcctagacagcg

SEQ ID NO: 3434 - RNA, 19 nt, synthetic construct
  source 1..19: mol_type = other RNA
ccaggtttgcctagacagc

SEQ ID NO: 3435 - RNA, 19 nt, synthetic construct
  source 1..19: mol_type = other RNA
tccaggtttgcctagacag

SEQ ID NO: 3436 - RNA, 19 nt, synthetic construct
  source 1..19: mol_type = other RNA
atccaggtttgcctagaca

SEQ ID NO: 3437 - RNA, 19 nt, synthetic construct
  source 1..19: mol_type = other RNA
aatccaggtttgcctagac

SEQ ID NO: 3438 - RNA, 19 nt, synthetic construct
  source 1..19: mol_type = other RNA
taatccaggtttgcctaga

SEQ ID NO: 3439 - RNA, 19 nt, synthetic construct
  source 1..19: mol_type = other RNA
ctaatccaggtttgcctag

SEQ ID NO: 3440 - RNA, 19 nt, synthetic construct
  source 1..19: mol_type = other RNA
tctaatccaggtttgccta

SEQ ID NO: 3441 - RNA, 19 nt, synthetic construct
  source 1..19: mol_type = other RNA
ctctaatccaggtttgcct

SEQ ID NO: 3442 - RNA, 19 nt, synthetic construct
  source 1..19: mol_type = other RNA
actctaatccaggtttgcc

SEQ ID NO: 3443 - RNA, 19 nt, synthetic construct
  source 1..19: mol_type = other RNA
aactctaatccaggtttgc

SEQ ID NO: 3444 - RNA, 19 nt, synthetic construct
  source 1..19: mol_type = other RNA
taactctaatccaggtttg

SEQ ID NO: 3445 - RNA, 19 nt, synthetic construct
  source 1..19: mol_type = other RNA
gtaactctaatccaggttt

SEQ ID NO: 3446 - RNA, 19 nt, synthetic construct
  source 1..19: mol_type = other RNA
tgtaactctaatccaggtt

SEQ ID NO: 3447 - RNA, 19 nt, synthetic construct
  source 1..19: mol_type = other RNA
atgtaactctaatccaggt

SEQ ID NO: 3448 - RNA, 19 nt, synthetic construct
  source 1..19: mol_type = other RNA
gatgtaactctaatccagg

SEQ ID NO: 3449 - RNA, 19 nt, synthetic construct
  source 1..19: mol_type = other RNA
agatgtaactctaatccag

SEQ ID NO: 3450 - RNA, 19 nt, synthetic construct
  source 1..19: mol_type = other RNA
gagatgtaactctaatcca

SEQ ID NO: 3451 - RNA, 19 nt, synthetic construct
  source 1..19: mol_type = other RNA
ggagatgtaactctaatcc

SEQ ID NO: 3452 - RNA, 19 nt, synthetic construct
  source 1..19: mol_type = other RNA
aggagatgtaactctaatc

SEQ ID NO: 3453 - RNA, 19 nt, synthetic construct
  source 1..19: mol_type = other RNA
caggagatgtaactctaat

SEQ ID NO: 3454 - RNA, 19 nt, synthetic construct
  source 1..19: mol_type = other RNA
ccaggagatgtaactctaa

SEQ ID NO: 3455 - RNA, 19 nt, synthetic construct
  source 1..19: mol_type = other RNA
tccaggagatgtaactcta

SEQ ID NO: 3456 - RNA, 19 nt, synthetic construct
  source 1..19: mol_type = other RNA
atccaggagatgtaactct

SEQ ID NO: 3457 - RNA, 19 nt, synthetic construct
  source 1..19: mol_type = other RNA
aactaatcatccaggagat

SEQ ID NO: 3458 - RNA, 19 nt, synthetic construct
  source 1..19: mol_type = other RNA
gaactaatcatccaggaga

SEQ ID NO: 3459 - RNA, 19 nt, synthetic construct
  source 1..19: mol_type = other RNA
tgaactaatcatccaggag

SEQ ID NO: 3460 - RNA, 19 nt, synthetic construct
  source 1..19: mol_type = other RNA
ctgaactaatcatccagga

SEQ ID NO: 3461 - RNA, 19 nt, synthetic construct
  source 1..19: mol_type = other RNA
tctgaactaatcatccagg

SEQ ID NO: 3462 - RNA, 19 nt, synthetic construct
  source 1..19: mol_type = other RNA
ctctgaactaatcatccag

SEQ ID NO: 3463 - RNA, 19 nt, synthetic construct
  source 1..19: mol_type = other RNA
gcttccgcggggagggtgc

SEQ ID NO: 3464 - RNA, 19 nt, synthetic construct
  source 1..19: mol_type = other RNA
ggcttccgcggggagggtg

SEQ ID NO: 3465 - RNA, 19 nt, synthetic construct
  source 1..19: mol_type = other RNA
gggcttccgcggggagggt

SEQ ID NO: 3466 - RNA, 19 nt, synthetic construct
  source 1..19: mol_type = other RNA
ccgggcttccgcggggagg

SEQ ID NO: 3467 - RNA, 19 nt, synthetic construct
  source 1..19: mol_type = other RNA
cgtccccgggcttccgcgg

SEQ ID NO: 3468 - RNA, 19 nt, synthetic construct
  source 1..19: mol_type = other RNA
ctcgtccccgggcttccgc

SEQ ID NO: 3469 - RNA, 19 nt, synthetic construct
  source 1..19: mol_type = other RNA
cctcgtccccgggcttccg

SEQ ID NO: 3470 - RNA, 19 nt, synthetic construct
  source 1..19: mol_type = other RNA
tctcattctgaaaccaaat

SEQ ID NO: 3471 - RNA, 19 nt, synthetic construct
  source 1..19: mol_type = other RNA
ggccgagattcccgccggt

SEQ ID NO: 3472 - RNA, 19 nt, synthetic construct
  source 1..19: mol_type = other RNA
cgcgtctcccgggccaggg

SEQ ID NO: 3473 - RNA, 19 nt, synthetic construct
  source 1..19: mol_type = other RNA
ccgcgtctcccgggccagg

SEQ ID NO: 3474 - RNA, 19 nt, synthetic construct
  source 1..19: mol_type = other RNA
gccgcgtctcccgggccag

SEQ ID NO: 3475 - RNA, 19 nt, synthetic construct
  source 1..19: mol_type = other RNA
ccttctggcgggccgcgtc

SEQ ID NO: 3476 - RNA, 19 nt, synthetic construct
  source 1..19: mol_type = other RNA
gccttctggcgggccgcgt

SEQ ID NO: 3477 - RNA, 19 nt, synthetic construct
  source 1..19: mol_type = other RNA
ggtccgctttcgccggcct

SEQ ID NO: 3478 - RNA, 19 nt, synthetic construct
  source 1..19: mol_type = other RNA
cggtccgctttcgccggcc

SEQ ID NO: 3479 - RNA, 19 nt, synthetic construct
  source 1..19: mol_type = other RNA
gcggtccgctttcgccggc

SEQ ID NO: 3480 - RNA, 19 nt, synthetic construct
  source 1..19: mol_type = other RNA
gctcggaggagcagggcgg

SEQ ID NO: 3481 - RNA, 19 nt, synthetic construct
  source 1..19: mol_type = other RNA
cccgggcggcgatgcctgg

SEQ ID NO: 3482 - RNA, 19 nt, synthetic construct
  source 1..19: mol_type = other RNA
tcctcccgggcggcgatgc

SEQ ID NO: 3483 - RNA, 19 nt, synthetic construct
  source 1..19: mol_type = other RNA
ctcctcccgggcggcgatg

SEQ ID NO: 3484 - RNA, 19 nt, synthetic construct
  source 1..19: mol_type = other RNA
gctcctcccgggcggcgat

SEQ ID NO: 3485 - RNA, 19 nt, synthetic construct
  source 1..19: mol_type = other RNA
agctcctcccgggcggcga

SEQ ID NO: 3486 - RNA, 19 nt, synthetic construct
  source 1..19: mol_type = other RNA
cagctcctcccgggcggcg

SEQ ID NO: 3487 - RNA, 19 nt, synthetic construct
  source 1..19: mol_type = other RNA
tgtcccgggtgcctggccc

SEQ ID NO: 3488 - RNA, 19 nt, synthetic construct
  source 1..19: mol_type = other RNA
ggcgccctgccaccctgtc

SEQ ID NO: 3489 - RNA, 19 nt, synthetic construct
  source 1..19: mol_type = other RNA
gggcgccctgccaccctgt

SEQ ID NO: 3490 - RNA, 19 nt, synthetic construct
  source 1..19: mol_type = other RNA
gcgggcgccctgccaccct

SEQ ID NO: 3491 - RNA, 19 nt, synthetic construct
  source 1..19: mol_type = other RNA
cgcgggcgccctgccaccc

SEQ ID NO: 3492 - RNA, 19 nt, synthetic construct
  source 1..19: mol_type = other RNA
tgcgcgggcgccctgccac

SEQ ID NO: 3493 - RNA, 19 nt, synthetic construct
  source 1..19: mol_type = other RNA
cgcgctgcacaggccgcct

SEQ ID NO: 3494 - RNA, 19 nt, synthetic construct
  source 1..19: mol_type = other RNA
ccgcgctgcacaggccgcc

SEQ ID NO: 3495 - RNA, 19 nt, synthetic construct
  source 1..19: mol_type = other RNA
gccgcgctgcacaggccgc

SEQ ID NO: 3496 - RNA, 19 nt, synthetic construct
  source 1..19: mol_type = other RNA
gccggtgtgggcgaaggcg

SEQ ID NO: 3497 - RNA, 19 nt, synthetic construct
  source 1..19: mol_type = other RNA
cgttccccacgcgccggtg

SEQ ID NO: 3498 - RNA, 19 nt, synthetic construct
  source 1..19: mol_type = other RNA
ccgttccccacgcgccggt

SEQ ID NO: 3499 - RNA, 19 nt, synthetic construct
  source 1..19: mol_type = other RNA
cccgttccccacgcgccgg

SEQ ID NO: 3500 - RNA, 19 nt, synthetic construct
  source 1..19: mol_type = other RNA
ccccgttccccacgcgccg

SEQ ID NO: 3501 - RNA, 19 nt, synthetic construct
  source 1..19: mol_type = other RNA
agccccgttccccacgcgc

SEQ ID NO: 3502 - RNA, 19 nt, synthetic construct
  source 1..19: mol_type = other RNA
cgtggggtgcgggaagccc

SEQ ID NO: 3503 - RNA, 19 nt, synthetic construct
  source 1..19: mol_type = other RNA
gcgcagggcacgtggggtg

SEQ ID NO: 3504 - RNA, 19 nt, synthetic construct
  source 1..19: mol_type = other RNA
gcgcgcagggcacgtgggg

SEQ ID NO: 3505 - RNA, 19 nt, synthetic construct
  source 1..19: mol_type = other RNA
aggcgcgcagggcacgtgg

SEQ ID NO: 3506 - RNA, 19 nt, synthetic construct
  source 1..19: mol_type = other RNA
ccaggcgcgcagggcacgt

SEQ ID NO: 3507 - RNA, 19 nt, synthetic construct
  source 1..19: mol_type = other RNA
ctgcctggctcacgaaagc

SEQ ID NO: 3508 - RNA, 19 nt, synthetic construct
  source 1..19: mol_type = other RNA
gctgcctggctcacgaaag

SEQ ID NO: 3509 - RNA, 19 nt, synthetic construct
  source 1..19: mol_type = other RNA
cgctgcctggctcacgaaa

SEQ ID NO: 3510 - RNA, 19 nt, synthetic construct
  source 1..19: mol_type = other RNA
ggcggccctcgctgcctgg

SEQ ID NO: 3511 - RNA, 19 nt, synthetic construct
  source 1..19: mol_type = other RNA
cggcctggctgggctgcag

SEQ ID NO: 3512 - RNA, 19 nt, synthetic construct
  source 1..19: mol_type = other RNA
cgcggcctggctgggctgc

SEQ ID NO: 3513 - RNA, 19 nt, synthetic construct
  source 1..19: mol_type = other RNA
gccggcgcggcctggctgg

SEQ ID NO: 3514 - RNA, 19 nt, synthetic construct
  source 1..19: mol_type = other RNA
atcccctctgccggcgcgg

SEQ ID NO: 3515 - RNA, 19 nt, synthetic construct
  source 1..19: mol_type = other RNA
gcgcgccggggcaggttgg

SEQ ID NO: 3516 - RNA, 19 nt, synthetic construct
  source 1..19: mol_type = other RNA
ccgcgcgccggggcaggtt

SEQ ID NO: 3517 - RNA, 19 nt, synthetic construct
  source 1..19: mol_type = other RNA
gtaggcgaaatccccgcgc

SEQ ID NO: 3518 - RNA, 19 nt, synthetic construct
  source 1..19: mol_type = other RNA
ccggggcggcgtaggcgaa

SEQ ID NO: 3519 - RNA, 19 nt, synthetic construct
  source 1..19: mol_type = other RNA
agccggggcggcgtaggcg

SEQ ID NO: 3520 - RNA, 19 nt, synthetic construct
  source 1..19: mol_type = other RNA
cgccccgtccggaggagcc

SEQ ID NO: 3521 - RNA, 19 nt, synthetic construct
  source 1..19: mol_type = other RNA
gcgccccgtccggaggagc

SEQ ID NO: 3522 - RNA, 19 nt, synthetic construct
  source 1..19: mol_type = other RNA
gagggtgggagagcgcccc

SEQ ID NO: 3523 - RNA, 19 nt, synthetic construct
  source 1..19: mol_type = other RNA
gctgcgggtcccggtcctc

SEQ ID NO: 3524 - RNA, 19 nt, synthetic construct
  source 1..19: mol_type = other RNA
ccgtcgcgctgcgggtccc

SEQ ID NO: 3525 - RNA, 19 nt, synthetic construct
  source 1..19: mol_type = other RNA
caggccgtcgcgctgcggg

SEQ ID NO: 3526 - RNA, 19 nt, synthetic construct
  source 1..19: mol_type = other RNA
ggctgtgccaccgcgcagg

SEQ ID NO: 3527 - RNA, 19 nt, synthetic construct
  source 1..19: mol_type = other RNA
ccaggctgtgccaccgcgc

SEQ ID NO: 3528 - RNA, 19 nt, synthetic construct
  source 1..19: mol_type = other RNA
cccaggctgtgccaccgcg

SEQ ID NO: 3529 - RNA, 19 nt, synthetic construct
  source 1..19: mol_type = other RNA
ggcccaggctgtgccaccg

SEQ ID NO: 3530 - RNA, 19 nt, synthetic construct
  source 1..19: mol_type = other RNA
gagcgggcccaggctgtgc

SEQ ID NO: 3531 - RNA, 19 nt, synthetic construct
  source 1..19: mol_type = other RNA
ccgcttgagcgggcccagg

SEQ ID NO: 3532 - RNA, 19 nt, synthetic construct
  source 1..19: mol_type = other RNA
gcaccccttggccctgcgg

SEQ ID NO: 3533 - RNA, 19 nt, synthetic construct
  source 1..19: mol_type = other RNA
acgtgggtggcgcaagcac

SEQ ID NO: 3534 - RNA, 19 nt, synthetic construct
  source 1..19: mol_type = other RNA
gacgtgggtggcgcaagca

SEQ ID NO: 3535 - RNA, 19 nt, synthetic construct
  source 1..19: mol_type = other RNA
ggacgtgggtggcgcaagc

SEQ ID NO: 3536 - RNA, 19 nt, synthetic construct
  source 1..19: mol_type = other RNA
gggacgtgggtggcgcaag

SEQ ID NO: 3537 - RNA, 19 nt, synthetic construct
  source 1..19: mol_type = other RNA
ctgggacgtgggtggcgca

SEQ ID NO: 3538 - RNA, 19 nt, synthetic construct
  source 1..19: mol_type = other RNA
cccagccccaccacggact

SEQ ID NO: 3539 - RNA, 19 nt, synthetic construct
  source 1..19: mol_type = other RNA
gacctggggaccccggccc

SEQ ID NO: 3540 - RNA, 19 nt, synthetic construct
  source 1..19: mol_type = other RNA
ggcgacctggggaccccgg

SEQ ID NO: 3541 - RNA, 19 nt, synthetic construct
  source 1..19: mol_type = other RNA
ggttcccacgccgccccgg

SEQ ID NO: 3542 - RNA, 19 nt, synthetic construct
  source 1..19: mol_type = other RNA
gcgggctggggaggtggag

SEQ ID NO: 3543 - RNA, 19 nt, synthetic construct
  source 1..19: mol_type = other RNA
ggcgcgggctggggaggtg

SEQ ID NO: 3544 - RNA, 19 nt, synthetic construct
  source 1..19: mol_type = other RNA
ggggcgcgggctggggagg

SEQ ID NO: 3545 - RNA, 19 nt, synthetic construct
  source 1..19: mol_type = other RNA
cccctgccgcgcggaggcg

SEQ ID NO: 3546 - RNA, 19 nt, synthetic construct
  source 1..19: mol_type = other RNA
atctgcccctgccgcgcgg

SEQ ID NO: 3547 - RNA, 19 nt, synthetic construct
  source 1..19: mol_type = other RNA
gcatctgcccctgccgcgc

SEQ ID NO: 3548 - RNA, 19 nt, synthetic construct
  source 1..19: mol_type = other RNA
ggctcctggagcgcctggg

SEQ ID NO: 3549 - RNA, 19 nt, synthetic construct
  source 1..19: mol_type = other RNA
cagaccagggcgccggctc

SEQ ID NO: 3550 - RNA, 19 nt, synthetic construct
  source 1..19: mol_type = other RNA
tgcagaccagggcgccggc

SEQ ID NO: 3551 - RNA, 19 nt, synthetic construct
  source 1..19: mol_type = other RNA
gtgcagaccagggcgccgg

SEQ ID NO: 3552 - RNA, 19 nt, synthetic construct
  source 1..19: mol_type = other RNA
agtgcagaccagggcgccg

SEQ ID NO: 3553 - RNA, 19 nt, synthetic construct
  source 1..19: mol_type = other RNA
tcgccaggagctcatccag

SEQ ID NO: 3554 - RNA, 19 nt, synthetic construct
  source 1..19: mol_type = other RNA
ccgaggcctccagctcccc

SEQ ID NO: 3555 - RNA, 19 nt, synthetic construct
  source 1..19: mol_type = other RNA
cttccgaggcctccagctc

SEQ ID NO: 3556 - RNA, 19 nt, synthetic construct
  source 1..19: mol_type = other RNA
tcttccgaggcctccagct

SEQ ID NO: 3557 - RNA, 19 nt, synthetic construct
  source 1..19: mol_type = other RNA
ctcttccgaggcctccagc

SEQ ID NO: 3558 - RNA, 19 nt, synthetic construct
  source 1..19: mol_type = other RNA
tgcttccagcgaggcggcc

SEQ ID NO: 3559 - RNA, 19 nt, synthetic construct
  source 1..19: mol_type = other RNA
gtgcttccagcgaggcggc

SEQ ID NO: 3560 - RNA, 19 nt, synthetic construct
  source 1..19: mol_type = other RNA
ggtgcttccagcgaggcgg

SEQ ID NO: 3561 - RNA, 19 nt, synthetic construct
  source 1..19: mol_type = other RNA
gggtgcttccagcgaggcg

SEQ ID NO: 3562 - RNA, 19 nt, synthetic construct
  source 1..19: mol_type = other RNA
ggggtgcttccagcgaggc

SEQ ID NO: 3563 - RNA, 19 nt, synthetic construct
  source 1..19: mol_type = other RNA
gaggggtgcttccagcgag

SEQ ID NO: 3564 - RNA, 19 nt, synthetic construct
  source 1..19: mol_type = other RNA
ggtattcttcctcgctgag

SEQ ID NO: 3565 - RNA, 19 nt, synthetic construct
  source 1..19: mol_type = other RNA
cggtattcttcctcgctga

SEQ ID NO: 3566 - RNA, 19 nt, synthetic construct
  source 1..19: mol_type = other RNA
cagagcccggtattcttcc

SEQ ID NO: 3567 - RNA, 19 nt, synthetic construct
  source 1..19: mol_type = other RNA
ctcctccagcagagcccgg

SEQ ID NO: 3568 - RNA, 19 nt, synthetic construct
  source 1..19: mol_type = other RNA
ctaaagctcctccagcaga

SEQ ID NO: 3569 - RNA, 19 nt, synthetic construct
  source 1..19: mol_type = other RNA
cctaaagctcctccagcag

SEQ ID NO: 3570 - RNA, 19 nt, synthetic construct
  source 1..19: mol_type = other RNA
gtcctaaagctcctccagc

SEQ ID NO: 3571 - RNA, 19 nt, synthetic construct
  source 1..19: mol_type = other RNA
cgtcctaaagctcctccag

SEQ ID NO: 3572 - RNA, 19 nt, synthetic construct
  source 1..19: mol_type = other RNA
cccgcgtcctaaagctcct

SEQ ID NO: 3573 - RNA, 19 nt, synthetic construct
  source 1..19: mol_type = other RNA
ccccgcgtcctaaagctcc

SEQ ID NO: 3574 - RNA, 19 nt, synthetic construct
  source 1..19: mol_type = other RNA
accccgcgtcctaaagctc

SEQ ID NO: 3575 - RNA, 19 nt, synthetic construct
  source 1..19: mol_type = other RNA
aaccccgcgtcctaaagct

SEQ ID NO: 3576 - RNA, 19 nt, synthetic construct
  source 1..19: mol_type = other RNA
caaccccgcgtcctaaagc

SEQ ID NO: 3577 - RNA, 19 nt, synthetic construct
  source 1..19: mol_type = other RNA
ccaaccccgcgtcctaaag

SEQ ID NO: 3578 - RNA, 19 nt, synthetic construct
  source 1..19: mol_type = other RNA
cccaaccccgcgtcctaaa

SEQ ID NO: 3579 - RNA, 19 nt, synthetic construct
  source 1..19: mol_type = other RNA
tcccaaccccgcgtcctaa

SEQ ID NO: 3580 - RNA, 19 nt, synthetic construct
  source 1..19: mol_type = other RNA
cgtcccaaccccgcgtcct

SEQ ID NO: 3581 - RNA, 19 nt, synthetic construct
  source 1..19: mol_type = other RNA
gaccccgtcccaaccccgc

SEQ ID NO: 3582 - RNA, 19 nt, synthetic construct
  source 1..19: mol_type = other RNA
cacccgaccccgtcccaac

SEQ ID NO: 3583 - RNA, 19 nt, synthetic construct
  source 1..19: mol_type = other RNA
gaaccacccgaccccgtcc

SEQ ID NO: 3584 - RNA, 19 nt, synthetic construct
  source 1..19: mol_type = other RNA
aatcccaggccggtcagcc

SEQ ID NO: 3585 - RNA, 19 nt, synthetic construct
  source 1..19: mol_type = other RNA
gaatcccaggccggtcagc

SEQ ID NO: 3586 - RNA, 19 nt, synthetic construct
  source 1..19: mol_type = other RNA
tagaaggcaggaatcccag

SEQ ID NO: 3587 - RNA, 19 nt, synthetic construct
  source 1..19: mol_type = other RNA
ctagaaggcaggaatccca

SEQ ID NO: 3588 - RNA, 19 nt, synthetic construct
  source 1..19: mol_type = other RNA
ctctcaccgggcctagacc

SEQ ID NO: 3589 - RNA, 19 nt, synthetic construct
  source 1..19: mol_type = other RNA
tctctcaccgggcctagac

SEQ ID NO: 3590 - RNA, 19 nt, synthetic construct
  source 1..19: mol_type = other RNA
gtctctcaccgggcctaga

SEQ ID NO: 3591 - RNA, 19 nt, synthetic construct
  source 1..19: mol_type = other RNA
agtctctcaccgggcctag

SEQ ID NO: 3592 - RNA, 19 nt, synthetic construct
  source 1..19: mol_type = other RNA
tggagtctctcaccgggcc

SEQ ID NO: 3593 - RNA, 19 nt, synthetic construct
  source 1..19: mol_type = other RNA
gtggagtctctcaccgggc

SEQ ID NO: 3594 - RNA, 19 nt, synthetic construct
  source 1..19: mol_type = other RNA
agtggagtctctcaccggg

SEQ ID NO: 3595 - RNA, 19 nt, synthetic construct
  source 1..19: mol_type = other RNA
acagcgtcggaaggtgggg

SEQ ID NO: 3596 - RNA, 19 nt, synthetic construct
  source 1..19: mol_type = other RNA
gacagcgtcggaaggtggg

SEQ ID NO: 3597 - RNA, 19 nt, synthetic construct
  source 1..19: mol_type = other RNA
cctagacagcgtcggaagg

SEQ ID NO: 3598 - RNA, 19 nt, synthetic construct
  source 1..19: mol_type = other RNA
gcctagacagcgtcggaag

SEQ ID NO: 3599 - RNA, 19 nt, synthetic construct
  source 1..19: mol_type = other RNA
tgcctagacagcgtcggaa

SEQ ID NO: 3600 - RNA, 19 nt, synthetic construct
  source 1..19: mol_type = other RNA
ttgcctagacagcgtcgga

SEQ ID NO: 3601 - RNA, 19 nt, synthetic construct
  source 1..19: mol_type = other RNA
tttgcctagacagcgtcgg

SEQ ID NO: 3602 - RNA, 19 nt, synthetic construct
  source 1..19: mol_type = other RNA
gtttgcctagacagcgtcg

What is claimed is:

1. An RNAi oligonucleotide comprising a sense strand and an antisense strand, wherein the sense strand and the antisense strand form a duplex, wherein the sense strand and antisense strands are selected from the group consisting of:

| SEQ ID NO: | Sense strand |
|---|---|
| 1240 | csgsacGfgAfGfAfcucguuugga |
| 1438 | asgsucCfaGfGfAfuucagaucua |
| 1443 | asusucAfgAfUfCfugguuucaga |
| 1626 | asasccUfcUfCfCfuagaaacgga |
| 1645 | ascsgcUfgUfCfUfaggcaaacca |
| 1654 | asgsgcAfaAfCfCfuggauuagaa |
| 1655 | gsgscaAfaCfCfUfggauuagaga |
| 1661 | cscsugGfaUfUfAfgaguuacaua |
| 1662 | csusggAfuUfAfGfaguuacauca |

-continued

| | |
|---|---|
| 1670 | asuscuCfcUfGfGfaugauuagua |
| 1671 | uscsucCfuGfGfAfugauuaguua |
| 1672 | csusccUfgGfAfUfgauuaguuca |
| 1673 | uscscuGfgAfUfGfauuaguucaa |
| 1674 | cscsugGfaUfGfAfuuaguucaga |
| 1675 | csusggAfuGfAfUfuaguucagaa |
| 1775 | gscscgCfcUfCfGfcuggaagcaa |
| 1790 | gsasgcUfuUfAfGfgacgcgggga |
| 1444 | csusggUfuUfCfAfgaaucgaaga |
| 2426 | csusGfguuUfCfAfgaAfucgaAfsgsa |
| 2427 | asgsGfcaaAfCfCfugGfauuaGfsasa |
| 2428 | gsgsCfaaaCfCfUfggAfuuagAfsgsa |
| 2429 | cscsUfggaUfUfAfgaGfuuacAfsusa |
| 2430 | csusGfgauUfAfGfagUfuacaUfscsa |
| 2431 | uscsUfccuGfGfAfugAfuuagUfsusa |
| 2432 | csusCfcugGfAfUfgaUfuaguUfscsa |
| 1728 | cscsgcGfcCfGfGfcagaggggaa |
| 2433 | cscsGfcgcCfGfGfcaGfagggGfsasa |

-continued

| | |
|---|---|
| 2434 | uscsCfuggAfUfGfauUfaguuCfaa |
| 2435 | cscsUfggaUfGfAfuuAfguucAfga |
| 2436 | csusGfgauGfAfUfuaGfuucaGfaa |

| SEQ ID NO: | Antisense strand |
|---|---|
| 1846 | usCfscaaAfcGfAfgucuCfcGfucgsusu |
| 2044 | usAfsgauCfuGfAfauccUfgGfacususu |
| 2049 | usCfsugaAfaCfCfagauCfuGfaaususu |
| 2232 | usCfscguUfuCfUfaggaGfaGfguusesu |
| 2251 | usGfsguuUfgCfCfuagaCfaGfcgususu |
| 2260 | usUfscuaAfuCfCfagguUfuGfccususu |
| 2261 | usCfsucuAfaUfCfcaggUfuUfgccsusu |
| 2267 | usAfsuguAfaCfUfcuaaUfcCfaggsusu |
| 2268 | usGfsaugUfaAfCfucuaAfuCfcagsusu |
| 2276 | usAfscuaAfuCfAfuccaGfgAfgaususu |
| 2277 | usAfsacuAfaUfCfauccAfgGfagasusu |
| 2278 | usGfsaacUfaAfUfcaucCfaGfgagsusu |
| 2279 | usUfsgaaCfuAfAfucauCfcAfggasusu |
| 2280 | usCfsugaAfcUfAfaucaUfcCfaggsusu |
| 2281 | usUfscugAfaCfUfaaucAfuCfcagsusu |
| 2381 | usUfsgcuUfcCfAfgcgaGfgCfggcsusu |
| 2396 | usCfscccGfcGfUfccuaAfaGfcucsusu |
| 2050 | usCfsuucGfaUfUfcugaAfaCfcagsusu |
| 2437 | vpUsCfsuucgauucugaAfaccagsusu |
| 2438 | vpUsUfscuaauccagguUfugccususu |
| 2439 | vpUsCfsucuaauccaggUfuugccsusu |
| 2440 | vpUsAfsuguaacucuaaUfccaggsusu |
| 2441 | vpUsGfsauguaacucuaAfuccagsusu |
| 2442 | vpUsAfsacuaaucauccAfggagasusu |
| 2443 | vpUsGfsaacuaaucaucCfaggagsusu |
| 2334 | usUfscccCfuCfUfgccgGfcGfcggsusu |
| 2444 | vpUsUfsccccucugccgGfcgcggsusu |
| 2445 | vpUsUfsgaacuaaucauCfcaggasusu |
| 2446 | vpUsCfsugaacuaaucaUfccaggsusu |
| 2447 | vpUsUfscugaacuaaucAfuccagsusu |

wherein:

Af represents 2'-deoxy-2'-fluoro-adenosine-3'-phosphate;

Afs represents 2'-deoxy-2'-fluoro-adenosine-3'-phosphorothioate;

Cf represents 2'-deoxy-2'-fluoro-cytidine-3'-phosphate;

Cfs represents 2'-deoxy-2'-fluoro-cytidine-3'-phosphorothioate;

Gf represents 2'-deoxy-2'-fluoro-guanosine-3'-phosphate;

Gfs represents 2'-deoxy-2'-fluoro-guanosine-3'-phosphorothioate;

Uf represents 2'-deoxy-2'-fluoro-uridine-3'-phosphate;

Ufs represents 2'-deoxy-2'-fluoro-uridine-3'-phosphorothioate;

a represents 2'-O-methyl-adenosine-3'-phosphate;

as represents 2'-O-methyl-adenosine-3'-phosphorothioate;

c represents 2'-O-methyl-cytidine-3'-phosphate;

cs represents 2'-O-methyl-cytidine-3'-phosphorothioate;

g represents 2'-O-methyl-guanosine-3'-phosphate;

gs represents 2'-O-methyl-guanosine-3'-phosphorothioate;

u represents 2'-O-methyl-uridine-3'-phosphate;

us represents 2'-O-methyl-uridine-3'-phosphorothioate; and vpUs represents 5'-vinylphosphonate-2'-O-methyl-uridine-3'-phosphorothioate.

2. The RNAi oligonucleotide of claim 1, wherein (i) the sense strand is csgsacGfgAfGfAfcucguuugga (SEQ ID NO: 1240), and the antisense strand is usCfscaaAfcGfAfgucuCfcGfucgsusu (SEQ ID NO: 1846); or (ii) the sense strand is asasccUfcUfCfCfuagaaacgga (SEQ ID NO: 1626), and the antisense strand is usCfscguUfuCfUfaggaGfaGfguususu (SEQ ID NO: 2232); or (iii) the sense strand is gscscgCfcUfCfGfcuggaagcaa (SEQ ID NO: 1775), and the antisense strand is usUfsgcuUfcCfAfgcgaGfgCfggcsusu (SEQ ID NO: 2381).

3. The RNAi oligonucleotide of claim 1, wherein the sense strand is asgsucCfaGfGfAfuucagaucua (SEQ ID NO: 1438), and the antisense strand is usAfsgauCfuGfAfauccUfgGfacususu (SEQ ID NO: 2044).

4. The RNAi oligonucleotide of claim 1, wherein the sense strand is asusucAfgAfUfCfugguuucaga (SEQ ID NO: 1443), and the antisense strand is usCfsugaAfaCfCfagauCfuGfaaususu (SEQ ID NO: 2049).

5. The RNAi oligonucleotide of claim 1, wherein the sense strand is ascsgcUfgUfCfUfaggcaaacca (SEQ ID NO: 1645), and the antisense strand is usGfsguuUfgCfCfuagaCfaGfcgususu (SEQ ID NO: 2251).

6. The RNAi oligonucleotide of claim 1, wherein the sense strand is asgsgcAfaAfCfCfuggauuagaa (SEQ ID NO: 1654), and the antisense strand is usUfscuaAfuCfCfagguUfuGfccususu (SEQ ID NO: 2260).

7. The RNAi oligonucleotide of claim 1, wherein the sense strand is gsgscaAfaCfCfUfggauuagaga (SEQ ID NO: 1655), and the antisense strand is usCfsucuAfaUfCfcaggUfuUfgccsusu (SEQ ID NO: 2261).

8. The RNAi oligonucleotide of claim 1, wherein the sense strand is cscsugGfaUfUfAfgaguuacaua (SEQ ID NO: 1661), and the antisense strand is usAfsuguAfaCfUfcuaaUfcCfaggsusu (SEQ ID NO: 2267).

9. The RNAi oligonucleotide of claim 1, wherein the sense strand is csusggAfuUfAfGfaguuacauca (SEQ ID NO: 1662), and the antisense strand is usGfsaugUfaAfCfucuaAfuCfcagsusu (SEQ ID NO: 2268).

10. The RNAi oligonucleotide of claim 1, wherein the sense strand is asuscuCfcUfGfGfaugauuagua (SEQ ID NO: 1670), and the antisense strand is usAfscuaAfuCfAfuccaGfgAfgaususu (SEQ ID NO: 2276).

11. The RNAi oligonucleotide of claim 1, wherein the sense strand is uscsucCfuGfGfAfugauuaguua (SEQ ID NO: 1671), and the antisense strand is usAfsacuAfaUfCfauccAfgGfagasusu (SEQ ID NO: 2277).

12. The RNAi oligonucleotide of claim 1, wherein the sense strand is csusccUfgGfAfUfgauuaguuca (SEQ ID NO: 1672), and the antisense strand is usGfsaacUfaAfUfcaucCfaGfgagsusu (SEQ ID NO: 2278).

13. The RNAi oligonucleotide of claim 1, wherein the sense strand is uscscuGfgAfUfGfauuaguucaa (SEQ ID NO: 1673), and the antisense strand is usUfsgaaCfuAfAfucauCfcAfggasusu (SEQ ID NO: 2279).

14. The RNAi oligonucleotide of claim 1, wherein the sense strand is cscsugGfaUfGfAfuuaguucaga (SEQ ID NO: 1674), and the antisense strand is usCfsugaAfcUfAfaucaUfcCfaggsusu (SEQ ID NO: 2280).

15. The RNAi oligonucleotide of claim 1, wherein the sense strand is csusggAfuGfAfUfuaguucagaa (SEQ ID NO: 1675), and the antisense strand is usUfscugAfaCfUfaaucAfuCfcagsusu (SEQ ID NO: 2281).

16. The RNAi oligonucleotide of claim 1, wherein the sense strand is gsasgcUfuUfAfGfgacgggga (SEQ ID NO: 1790), and the antisense strand is usCfscccGfcGfUfccuaAfaGfcucsusu (SEQ ID NO: 2396).

17. The RNAi oligonucleotide of claim 1, wherein the sense strand is csusggUfuUfCfAfgaaucgaaga (SEQ ID NO: 1444), and the antisense strand is usCfsuucGfaUfUfcugaAfaCfcagsusu (SEQ ID NO: 2050).

18. The RNAi oligonucleotide of claim 1, wherein the sense strand is csusGfguuUfCfAfgaAfucgaAfsgsa (SEQ ID NO: 2426), and the antisense strand is vpUsCfsuucgauucugaAfaccagsusu (SEQ ID NO: 2437).

19. The RNAi oligonucleotide of claim 1, wherein the sense strand is asgsGfcaaAfCfCfugGfauuaGfsasa (SEQ ID NO: 2427), and the antisense strand is vpUsUfscuaauccagguUfugccususu (SEQ ID NO: 2438).

20. The RNAi oligonucleotide of claim 1, wherein the sense strand is gsgsCfaaaCfCfUfggAfuuagAfsgsa (SEQ ID NO: 2428), and the antisense strand is vpUsCfsucuaauccaggUfuugccsusu (SEQ ID NO: 2439).

21. The RNAi oligonucleotide of claim 1, wherein the sense strand is cscsUfggaUfUfAfgaGfuuacAfsusa (SEQ ID NO: 2429), and the antisense strand is vpUsAfsuguaacucuaaUfccaggsusu (SEQ ID NO: 2440).

22. The RNAi oligonucleotide of claim 1, wherein the sense strand is csusGfgauUfAfGfagUfuacaUfscsa (SEQ ID NO: 2430), and the antisense strand is vpUsGfsauguaacucuaAfuccagsusu (SEQ ID NO: 2441).

23. The RNAi oligonucleotide of claim 1, wherein the sense strand is uscsUfccuGfGfAfugAfuuagUfsusa (SEQ ID NO: 2431), and the antisense strand is vpUsAfsacuaaucauccAfggagasusu (SEQ ID NO: 2442).

24. The RNAi oligonucleotide of claim 1, wherein the sense strand is csusCfcugGfAfUfgaUfuaguUfscsa (SEQ ID NO: 2432), and the antisense strand is vpUsGfsaacuaaucaucCfaggagsusu (SEQ ID NO: 2443).

25. The RNAi oligonucleotide of claim 1, wherein the sense strand is cscsgcGfcCfGfGfcagaggggaa (SEQ ID NO: 1728), and the antisense strand is usUfscccCfuCfUfgccgGfcGfcggsusu (SEQ ID NO: 2334).

26. The RNAi oligonucleotide of claim 1, wherein the sense strand is cscsGfcgcCfGfGfcaGfagggGfsasa (SEQ ID NO: 2433), and the antisense strand is vpUsUfsccccucugccgGfcgcggsusu (SEQ ID NO: 2444).

27. The RNAi oligonucleotide of claim 1, wherein the sense strand is uscsCfuggAfUfGfauUfaguuCfaa (SEQ ID NO: 2434), and the antisense strand is vpUsUfsgaacuaaucauCfcaggasusu (SEQ ID NO: 2445).

28. The RNAi oligonucleotide of claim 1, wherein the sense strand is cscsUfggaUfGfAfuuAfguucAfga (SEQ ID NO: 2435), and the antisense strand is vpUsCfsugaacuaaucaUfccaggsusu (SEQ ID NO: 2446).

29. The RNAi oligonucleotide of claim 1, wherein the sense strand is csusGfgauGfAfUfuaGfuucaGfaa (SEQ ID NO: 2436), and the antisense strand is vpUsUfscugaacuaaucAfuccagsusu (SEQ ID NO: 2447).

30. A pharmaceutical composition comprising the RNAi oligonucleotide of claim 1, or a pharmaceutically acceptable salt thereof, and a pharmaceutically acceptable carrier or excipient.

* * * * *